United States Patent 11,931,406 (FLAVIVIRUS VACCINE) - sequence listing, part 5

SEQ ID NO: 4052 - protein, 3291 aa, Artificial Sequence
  derived and/or modified protein sequence (wt) from DENV-2__KF955372__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEYAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNVEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASTAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4053 - protein, 3291 aa, Artificial Sequence
  derived and/or modified protein sequence (wt) from DENV-2__KF955373__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPLSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4054 - protein, 3291 aa, Artificial Sequence
  derived and/or modified protein sequence (wt) from DENV-2__GQ868600__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMVIPKNFAGPVSQHNNRPGYHTQTAGPWHLGKLEMDFDFCEGTTVVVTEDCGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGNIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKSIQHLTASEEIAVQDWLVRVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNKVWILENPWMEDKTPVESWEEIPYLGKREDQWCGSLIGLTSRATWAKNIQTAINQVRSLIGNEEYTDYMPSMKRFRREEEEAGVLW

SEQ ID NO: 4055 - protein, 3291 aa, Artificial Sequence
  derived and/or modified protein sequence (wt) from DENV-2__KF955359__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRALIFILLTAVAPSMTMRCIGISNRDFVEGVSGGSWVDIVLEHGSCVTTMAKNKPTLDFELIKTEAKQPAILRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSASLVLVGIVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELEKAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4056 - protein, 3291 aa, Artificial Sequence
  derived and/or modified protein sequence (wt) from DENV-2__KF955360__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4057 - protein, 3291 aa, Artificial Sequence
  derived and/or modified protein sequence (wt) from DENV-2__KF955363__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQVTPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMVISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4058 - protein, 3291 aa, Artificial Sequence
  derived and/or modified protein sequence (wt) from DENV-2__EU726767__SS-prME
SAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCATTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDVKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCEGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFMTLITGNMSFKDLGRVVVMVGAAMTDDIGMGVTYLALLAAFKVRPTFAAGLLLRKLTSKELMMTTIGIALLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIVTQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERSLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4059 - protein, 3291 aa, Artificial Sequence
  derived and/or modified protein sequence (wt) from DENV-2__EU687246__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVALSFVTLITGNMSFKDLGRVVVMVGATMTDDIGMGVTYLALLAAFKVRPTFAAGLLLRKLTSKELMMTTIGIVLLSQSNIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGSEEYTDYMPSMKRFRREEEEAGVLW

SEQ ID NO: 4060 - protein, 3291 aa, Artificial Sequence
  derived and/or modified protein sequence (wt) from DENV-2__FJ639828__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIATEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLFLRKLTSKELMMTTIGIVLLSQSTLPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLTHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4061 - protein, 3291 aa, Artificial Sequence
  derived and/or modified protein sequence (wt) from DENV-2__FJ639829__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLFLRKLTSKELMMTTIGIVLLSQSTIPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLTHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQVAINQVRSLIGNEEYTDYMPSMKRFRREEEEAGVLW

SEQ ID NO: 4062 - protein, 3291 aa, Artificial Sequence
  derived and/or modified protein sequence (wt) from DENV-2__FJ639831__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSIVDRGWGNGCGLFGKGGIVTCAMFTCKKNMEGKIVQPENLEYTIVVTPHSGEEHAVGNDTGKHGKEIKVTPQSSVTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVVVMVGATMTDDIGMGVTYLALLAAFKVRPTFVAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGVLGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWAMCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKTTYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERKLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLIYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4063 - protein, 3291 aa, Artificial Sequence
  derived and/or modified protein sequence (wt) from DENV-2__FJ639832__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4064 - protein, 3291 aa, Artificial Sequence
  derived and/or modified protein sequence (wt) from DENV-2__FJ687434__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEARLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTSLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQAMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4065 - protein, 3291 aa, Artificial Sequence
  derived and/or modified protein sequence (wt) from DENV-2__FJ687439__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIATEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIVMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNISLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4066 - protein, 3291 aa, Artificial Sequence
  derived and/or modified protein sequence (wt) from DENV-2__FJ687440__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWITYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFTGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4067 - protein, 3291 aa, Artificial Sequence
  derived and/or modified protein sequence (wt) from DENV-2__FJ687441__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWITYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4068 - protein, 3291 aa, Artificial Sequence
  derived and/or modified protein sequence (wt) from DENV-2__FJ687445__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLFLRKLTSKELMMTTIGIVLLSQSTIPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLTHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPHDPKFEKQLGQVMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQVAINQVRSLIGNEEYTDYMPSMKRFRREEEEAGVLW

SEQ ID NO: 4069 - protein, 3291 aa, Artificial Sequence
  derived and/or modified protein sequence (wt) from DENV-2__FJ687447__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTSLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPIGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAFKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4070 - protein, 3291 aa, Artificial Sequence
  derived and/or modified protein sequence (wt) from DENV-2__FJ810411__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTSLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPIGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAFKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4071 - protein, 3291 aa, Artificial Sequence
  derived and/or modified protein sequence (wt) from DENV-2__FJ744713__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTSLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQILTILIRTGLLVISGLFPISIPITAAAWYLWEVKKQRAGVLWDVPSPPPIGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAFKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4072 - protein, 3291 aa, Artificial Sequence
  derived and/or modified protein sequence (wt) from DENV-2__FJ744714__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKRILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4073 - protein, 3291 aa, Artificial Sequence
  derived and/or modified protein sequence (wt) from DENV-2__FJ744716__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKRILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLRTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4074 - protein, 3291 aa, Artificial Sequence
  derived and/or modified protein sequence (wt) from DENV-2__FJ744718__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGSPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4075 - protein, 3291 aa, Artificial Sequence
  derived and/or modified protein sequence (wt) from DENV-2__FJ744722__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEAKLTNTTTESRCPTQGEPNLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLFLRKLTSKELMMTTIGIVLLSQSTIPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLTHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQVAINQVRSLIGNEEYTDYMPSMKRFRREEEEAGVLW

SEQ ID NO: 4076 - protein, 3291 aa, Artificial Sequence
  derived and/or modified protein sequence (wt) from DENV-2__FJ744723__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRTLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLFLRKLTSKELMMTTIGIVLLSQSTIPETILELTDALALGMMVLKMVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQRGILGYSQIGAGVYKEGTFHTMWHVTRGAVLTHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNSRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEETAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQVAINQVRSLIGNEEYTDYMPSMKRFRREEEEAGVLW

SEQ ID NO: 4077 - protein, 3291 aa, Artificial Sequence
  derived and/or modified protein sequence (wt) from DENV-2__FJ744724__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSIVDRGWGNGCGLFGKGGIVTCAMFTCKKNMEGKIVQPENLEYTIVVTPHSGEEHAVGNDTGKHGKEIKVTPQSSVTEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQTAINQVRSLIGNEEYTDYMPSMKRFRREEEEAGVLW

SEQ ID NO: 4078 - protein, 3291 aa, Artificial Sequence
  derived and/or modified protein sequence (wt) from DENV-2__FJ906957__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAASFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4079 - protein, 3291 aa, Artificial Sequence
  derived and/or modified protein sequence (wt) from DENV-2__FJ906958__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKVPFEIMDLEKRYVLGRLITVNPVVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAVKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGQGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYAKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4080 - protein, 3291 aa, Artificial Sequence
  derived and/or modified protein sequence (wt) from DENV-2__FJ898452__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4081 - protein, 3291 aa, Artificial Sequence
  derived and/or modified protein sequence (wt) from DENV-2__GQ868591__SS-prME
SAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFADENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4082 - protein, 3291 aa, Artificial Sequence
  derived and/or modified protein sequence (wt) from DENV-2__GQ868542__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGGIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGTMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVDSWEEIPYLGKREDQWCGSLIGLTSRATWAKNIQAAINQVRSLIGNEEYTDYMPSMKRFRREEEEAGVLW

SEQ ID NO: 4083 - protein, 3291 aa, Artificial Sequence
  derived and/or modified protein sequence (wt) from DENV-2__GQ868544__SS-prME
SVGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKVPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGQGQIDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLYKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4084 - protein, 3291 aa, Artificial Sequence
  derived and/or modified protein sequence (wt) from DENV-2__GQ868545__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSIVDRGWGNGCGLFGKGGIVTCAMFTCKKNMEGKIVQPENLEYTIVVTPHSGEEHAVGNDTGKHGKEIKVTPQSSVTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVVVMVGATMTDDIGMGVTYLALLAAFKVRPTLAAGLLLRKLTSKELMMTTIGIVLLSQSTIPETILELTDALALGMMVLKIVRDMEKYQLAVTIMATLCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPDIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERKLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4085 - protein, 3291 aa, Artificial Sequence
  derived and/or modified protein sequence (wt) from DENV-2__GQ868543__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGMFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLVTGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4086 - protein, 3291 aa, Artificial Sequence
  derived and/or modified protein sequence (wt) from DENV-2__EU482544__SS-prME
TAGVIIMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4087 - protein, 3291 aa, Artificial Sequence
  derived and/or modified protein sequence (wt) from DENV-2__EU482545__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIMITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIRNEEEEQTLTILIRTGLLVISGVFPVSIPVTAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4088 - protein, 3291 aa, Artificial Sequence
  derived and/or modified protein sequence (wt) from DENV-2__EU482546__SS-prME
TAGVIVMLIPTVMAFHLTTRNGEPHMIVGRQEKGKSLLFKTEDGINMCTLMAIDLGELCEDTITYKCPLLKQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDAFCDSKLMSAAIKDNRAVHADMGYWIESALNDTWKMEKASFIEVKSCHWPKSHTLWSNGVLESEMIIPKNFAGPVSQHNHRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGFLGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRVCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAISQVRSLIGNEEYTDYMPSMKRFRREEEEAGVLW

SEQ ID NO: 4089 - protein, 3291 aa, Artificial Sequence
  derived and/or modified protein sequence (wt) from DENV-2__EU482550__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRSQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTLVESWEEVPYLGKREDQWCGSLIGLTSRATWAKNIQTAINQVRSLIGNEEYTDYMPSMKRFRKEEEEAGVLW

SEQ ID NO: 4090 - protein, 3291 aa, Artificial Sequence
  derived and/or modified protein sequence (wt) from DENV-2__EU482551__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELEKAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4091 - protein, 3291 aa, Artificial Sequence
  derived and/or modified protein sequence (wt) from DENV-2__EU482552__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSTGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGYGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4092 - protein, 3291 aa, Artificial Sequence
  derived and/or modified protein sequence (wt) from DENV-2__EU482554__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGTVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRSQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTLVESWEEVPYLGKREDQWCGSLIGLTSRATWAKNIQTAINQVRSLIGNEEYTDYMPSMKRFRKEEEEAGVLW

SEQ ID NO: 4093 - protein, 3291 aa, Artificial Sequence
  derived and/or modified protein sequence (wt) from DENV-2__EU482556__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLVSHEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAVLGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTLMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLVRVGRERLSRMAVSGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4094 - protein, 3291 aa, Artificial Sequence
  derived and/or modified protein sequence (wt) from DENV-2__EU529693__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4095 - protein, 3291 aa, Artificial Sequence
  derived and/or modified protein sequence (wt) from DENV-2__EU482557__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4096 - protein, 3291 aa, Artificial Sequence
  derived and/or modified protein sequence (wt) from DENV-2__EU482560__SS-prME
TAGVIVMLIPTVMAFHLTTRNGEPHMIVGRQEKGKSLLFKTEDGINMCTLMAIDLGELCEDTITYKCPLLKQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDAFCDSKLMSAAIKDNRAVHADMGYWIESALNDTWKMEKASFIEVKSCHWPKSHTLWSNGVLESEMIIPKNFAGPVSQHNHRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSLVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGFLGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIENNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRVCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAISQVRSLIGNEEYTDYMPSMKRFRREEEEAGVLW

SEQ ID NO: 4097 - protein, 3291 aa, Artificial Sequence
  derived and/or modified protein sequence (wt) from DENV-2__EU482561__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVVVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4098 - protein, 3291 aa, Artificial Sequence
  derived and/or modified protein sequence (wt) from DENV-2__EU569703__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4099 - protein, 3291 aa, Artificial Sequence
  derived and/or modified protein sequence (wt) from DENV-2__EU529694__SS-prME
TAGVFIMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4100 - protein, 3291 aa, Artificial Sequence
  derived and/or modified protein sequence (wt) from DENV-2__EU529695__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4101 - protein, 3291 aa, Artificial Sequence
  derived and/or modified protein sequence (wt) from DENV-2__EU482562__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVILYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASFMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4102 - protein, 3291 aa, Artificial Sequence
  derived and/or modified protein sequence (wt) from DENV-2__EU482565__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPPKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNVGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4103 - protein, 3291 aa, Artificial Sequence
  derived and/or modified protein sequence (wt) from DENV-2__EU529700__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNLEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4104 - protein, 3291 aa, Artificial Sequence
  derived and/or modified protein sequence (wt) from DENV-2__EU529701__SS-prME
TAGVIIMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKIFIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4105 - protein, 3291 aa, Artificial Sequence
  derived and/or modified protein sequence (wt) from DENV-2__EU569704__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4106 - protein, 3291 aa, Artificial Sequence
  derived and/or modified protein sequence (wt) from DENV-2__EU482568__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRVEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWALMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4107 - protein, 3291 aa, Artificial Sequence
  derived and/or modified protein sequence (wt) from DENV-2__EU482569__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKNEFQIYKKSGIQEVDRTLAKEGIKRGETDHHAVSRGSAKLRWFVERNMVIPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4108 - protein, 3291 aa, Artificial Sequence
  derived and/or modified protein sequence (wt) from DENV-2__EU482570__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQVTPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVGCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILKDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMVISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4109 - protein, 3291 aa, Artificial Sequence
  derived and/or modified protein sequence (wt) from DENV-2__EU482571__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAAWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4110 - protein, 3291 aa, Artificial Sequence
  derived and/or modified protein sequence (wt) from DENV-2__EU482572__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQVTPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTGDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVMMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYEAKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMVISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4111 - protein, 3291 aa, Artificial Sequence
  derived and/or modified protein sequence (wt) from DENV-2__EU482573__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4112 - protein, 3291 aa, Artificial Sequence
  derived and/or modified protein sequence (wt) from DENV-2__EU482574__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLHMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4113 - protein, 3291 aa, Artificial Sequence
  derived and/or modified protein sequence (wt) from DENV-2__EU482575__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGERRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4114 - protein, 3291 aa, Artificial Sequence
  derived and/or modified protein sequence (wt) from DENV-2__EU482578__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4115 - protein, 3291 aa, Artificial Sequence
  derived and/or modified protein sequence (wt) from DENV-2__EU482580__SS-prME
TAGVIIMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKIFIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4116 - protein, 3291 aa, Artificial Sequence
  derived and/or modified protein sequence (wt) from DENV-2__EU482581__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4117 - protein, 3291 aa, Artificial Sequence
  derived and/or modified protein sequence (wt) from DENV-2__EU482582__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTNHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAVFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSTTTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSTVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4118 - protein, 3291 aa, Artificial Sequence
  derived and/or modified protein sequence (wt) from DENV-2__EU482583__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDAEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4119 - protein, 3291 aa, Artificial Sequence
  derived and/or modified protein sequence (wt) from DENV-2__EU482585__SS-prME
TAGVIIMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGGIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNSNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4120 - protein, 3291 aa, Artificial Sequence
  derived and/or modified protein sequence (wt) from DENV-2__EU482587__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEVELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSRELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNRTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHEIVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4121 - protein, 3291 aa, Artificial Sequence
  derived and/or modified protein sequence (wt) from DENV-2__EU482588__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKVPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4122 - protein, 3291 aa, Artificial Sequence
  derived and/or modified protein sequence (wt) from DENV-2__EU569705__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIVIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4123 - protein, 3291 aa, Artificial Sequence
  derived and/or modified protein sequence (wt) from DENV-2__EU482589__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRMGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNLAGPVSQHNYRPGYHTQTAGPWHLGKLEMDFDFCEGTTVVVTEDCGNRGPSLRTTTASGKLVTEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4124 - protein, 3291 aa, Artificial Sequence
  derived and/or modified protein sequence (wt) from DENV-2__EU569706__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNLEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4125 - protein, 3291 aa, Artificial Sequence
  derived and/or modified protein sequence (wt) from DENV-2__EU569707__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLRMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4126 - protein, 3291 aa, Artificial Sequence
  derived and/or modified protein sequence (wt) from DENV-2__EU660399__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRQGKVVGLYGNGVVTRSGAYVSAIAQTEKSIEDNPEIEDDIFRKKRLTIMDLHPGAGKTKKYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4127 - protein, 3291 aa, Artificial Sequence
  derived and/or modified protein sequence (wt) from DENV-2__EU569708__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIITGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSVTISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIERIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAVFTDENKWKSAREAVEDSRFWELVDRERNLHLEGKCETCVYNMMGKREKKLGEFGKAKGSRAIWYMWLGARFLEFEALGFLNEDHWFSRRNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4128 - protein, 3291 aa, Artificial Sequence
  derived and/or modified protein sequence (wt) from DENV-2__EU569709__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4129 - protein, 3291 aa, Artificial Sequence
  derived and/or modified protein sequence (wt) from DENV-2__EU596485__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTDSHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFARKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4130 - protein, 3291 aa, Artificial Sequence
  derived and/or modified protein sequence (wt) from DENV-2__EU569710__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALTFILLTAVAPSMTMRCIGISNRDFVEGVSGGSWVDIVLEHGSCVTTMAKNKPTLDFELIKTEAKQPAILRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4131 - protein, 3291 aa, Artificial Sequence
  derived and/or modified protein sequence (wt) from DENV-2__EU596486__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRSQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYIDYMPSMKRFRKEEEEAGVLW

SEQ ID NO: 4132 - protein, 3291 aa, Artificial Sequence
  derived and/or modified protein sequence (wt) from DENV-2__EU687212__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIITEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPVPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4133 - protein, 3291 aa, Artificial Sequence
  derived and/or modified protein sequence (wt) from DENV-2__EU660400__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTTVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSRQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4134 - protein, 3291 aa, Artificial Sequence
  derived and/or modified protein sequence (wt) from DENV-2__EU569711__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4135 - protein, 3291 aa, Artificial Sequence
  derived and/or modified protein sequence (wt) from DENV-2__EU569712__SS-prME
TAGMIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVRNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4136 - protein, 3291 aa, Artificial Sequence
  derived and/or modified protein sequence (wt) from DENV-2__EU596487__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4137 - protein, 3291 aa, Artificial Sequence
  derived and/or modified protein sequence (wt) from DENV-2__EU569713__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGSDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEAKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFYTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEKAGVLW

SEQ ID NO: 4138 - protein, 3291 aa, Artificial Sequence
  derived and/or modified protein sequence (wt) from DENV-2__EU569714__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHVILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAVVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4139 - protein, 3291 aa, Artificial Sequence
  derived and/or modified protein sequence (wt) from DENV-2__EU569715__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPGGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4140 - protein, 3291 aa, Artificial Sequence
  derived and/or modified protein sequence (wt) from DENV-2__EU569716__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFICKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRSQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4141 - protein, 3291 aa, Artificial Sequence
  derived and/or modified protein sequence (wt) from DENV-2__EU569717__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLVNRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4142 - protein, 3291 aa, Artificial Sequence
  derived and/or modified protein sequence (wt) from DENV-2__EU569718__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEYAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNVEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4143 - protein, 3291 aa, Artificial Sequence
  derived and/or modified protein sequence (wt) from DENV-2__EU596488__SS-prME
TAGVIIMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTINTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4144 - protein, 3291 aa, Artificial Sequence
  derived and/or modified protein sequence (wt) from DENV-2__EU596489__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADTGCVVSWKNKELKCGSGIFITDNVHTWTEQYKFQPEFPSKLASAIKKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELEKAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4145 - protein, 3291 aa, Artificial Sequence
  derived and/or modified protein sequence (wt) from DENV-2__EU596490__SS-prME
TAGVIIMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDVGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4146 - protein, 3291 aa, Artificial Sequence
  derived and/or modified protein sequence (wt) from DENV-2__EU596491__SS-prME
TAGVIIMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDAPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAHNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4147 - protein, 3291 aa, Artificial Sequence
  derived and/or modified protein sequence (wt) from DENV-2__EU677141__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4148 - protein, 3291 aa, Artificial Sequence
  derived and/or modified protein sequence (wt) from DENV-2__EU677144__SS-prME
TAGMIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGLNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAILCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPMEKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVRNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4149 - protein, 3291 aa, Artificial Sequence
  derived and/or modified protein sequence (wt) from DENV-2__EU677145__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIITEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPVPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4150 - protein, 3291 aa, Artificial Sequence
  derived and/or modified protein sequence (wt) from DENV-2__EU677146__SS-prME
TVGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEAKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4151 - protein, 3291 aa, Artificial Sequence
  derived and/or modified protein sequence (wt) from DENV-2__EU687214__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTNFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALIALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4152 - protein, 3291 aa, Artificial Sequence
  derived and/or modified protein sequence (wt) from DENV-2__EU687215__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTKTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATAFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4153 - protein, 3291 aa, Artificial Sequence
  derived and/or modified protein sequence (wt) from DENV-2__EU687216__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFNFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVELMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4154 - protein, 3291 aa, Artificial Sequence
  derived and/or modified protein sequence (wt) from DENV-2__EU726770__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGTMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4155 - protein, 3291 aa, Artificial Sequence
  derived and/or modified protein sequence (wt) from DENV-2__EU781135__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4156 - protein, 3291 aa, Artificial Sequence
  derived and/or modified protein sequence (wt) from DENV-2__EU687222__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4157 - protein, 3291 aa, Artificial Sequence
  derived and/or modified protein sequence (wt) from DENV-2__EU687223__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGAFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4158 - protein, 3291 aa, Artificial Sequence
  derived and/or modified protein sequence (wt) from DENV-2__EU687227__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNQMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4159 - protein, 3291 aa, Artificial Sequence
  derived and/or modified protein sequence (wt) from DENV-2__EU687228__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGNEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4160 - protein, 3291 aa, Artificial Sequence
  derived and/or modified protein sequence (wt) from DENV-2__EU687230__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRGTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4161 - protein, 3291 aa, Artificial Sequence
  derived and/or modified protein sequence (wt) from DENV-2__EU687231__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIENIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4162 - protein, 3291 aa, Artificial Sequence
  derived and/or modified protein sequence (wt) from DENV-2__EU687199__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEMMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4163 - protein, 3291 aa, Artificial Sequence
  derived and/or modified protein sequence (wt) from DENV-2__EU687235__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPLVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4164 - protein, 3291 aa, Artificial Sequence
  derived and/or modified protein sequence (wt) from DENV-2__EU687236__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELEKAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTKKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4165 - protein, 3291 aa, Artificial Sequence
  derived and/or modified protein sequence (wt) from DENV-2__EU687237__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4166 - protein, 3291 aa, Artificial Sequence
  derived and/or modified protein sequence (wt) from DENV-2__EU687238__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVTITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4167 - protein, 3291 aa, Artificial Sequence
  derived and/or modified protein sequence (wt) from DENV-2__EU687240__SS-prME
TVGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEAKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4168 - protein, 3291 aa, Artificial Sequence
  derived and/or modified protein sequence (wt) from DENV-2__EU687241__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYSIGTTHFQRALIFILLTAVAPSMTMRCIGISNRDFVEGVSGGSWVDIVLEHGSCVTTMAKNKPTLDFELTKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRTMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVVTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4169 - protein, 3291 aa, Artificial Sequence
  derived and/or modified protein sequence (wt) from DENV-2__EU687242__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCYWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALNELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4170 - protein, 3291 aa, Artificial Sequence
  derived and/or modified protein sequence (wt) from DENV-2__EU687243__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALNELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4171 - protein, 3291 aa, Artificial Sequence
  derived and/or modified protein sequence (wt) from DENV-2__EU687245__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALNELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNARRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTSRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAVNQVRSLIGNEEYTDYMPSMKRFRKEEEEAGVLW

SEQ ID NO: 4172 - protein, 3290 aa, Artificial Sequence
  derived and/or modified protein sequence (wt) from DENV-2__HQ541798__SS-prME
TAGMIFMLIPTVMAFHLTTRNGEPHMIVSRQEKGKSLLFKTGDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQSATLRKYCIEAKLTNTTTESRCPTQGEPSLNEEQDKRFVCKHSMVDRGWGNGCGLFGKGGIVTCAMFTCKKDMKGEVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMLETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKPHTLWSNEVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSLPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLSLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTAEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4173 - protein, 3291 aa, Artificial Sequence
  derived and/or modified protein sequence (wt) from DENV-2__JF730053__SS-prME
TAGMIIMLIPTVMAFHLTTRNGEPHMIVSRQEKGKSLLFKTGDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQSATLRKYCIEAKLTNTTTESRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMLETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNEVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSLPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLSLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTAEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4174 - protein, 3291 aa, Artificial Sequence
  derived and/or modified protein sequence (wt) from DENV-2__EU529706__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCVKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGRKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4175 - protein, 3291 aa, Artificial Sequence
  derived and/or modified protein sequence (wt) from DENV-2__EU482720__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIATEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELEKAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARTYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4176 - protein, 3291 aa, Artificial Sequence
  derived and/or modified protein sequence (wt) from DENV-2__EU482721__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTTMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4177 - protein, 3291 aa, Artificial Sequence
  derived and/or modified protein sequence (wt) from DENV-2__EU482722__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERVADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKTLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVIPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4178 - protein, 3291 aa, Artificial Sequence
  derived and/or modified protein sequence (wt) from DENV-2__EU482723__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSERAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4179 - protein, 3291 aa, Artificial Sequence
  derived and/or modified protein sequence (wt) from DENV-2__EU482724__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTSRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4180 - protein, 3291 aa, Artificial Sequence
  derived and/or modified protein sequence (wt) from DENV-2__EU482725__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVRKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSQLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4181 - protein, 3291 aa, Artificial Sequence
  derived and/or modified protein sequence (wt) from DENV-2__EU482726__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCIGKFKIVKEIAETQHGTIVIRVQYEGDGSPCKIPFEITDLEKRHVLGRLITVNPIVTEKDAPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4182 - protein, 3291 aa, Artificial Sequence
  derived and/or modified protein sequence (wt) from DENV-2__EU482727__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAYWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRRNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4183 - protein, 3291 aa, Artificial Sequence
  derived and/or modified protein sequence (wt) from DENV-2__EU482728__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSLVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4184 - protein, 3291 aa, Artificial Sequence
  derived and/or modified protein sequence (wt) from DENV-2__EU482729__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGEIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQIAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLIAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAYWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRRNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4185 - protein, 3291 aa, Artificial Sequence
  derived and/or modified protein sequence (wt) from DENV-2__EU482731__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDAPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAHNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4186 - protein, 3291 aa, Artificial Sequence
  derived and/or modified protein sequence (wt) from DENV-2__EU482732__SS-prME
TVGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGAFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4187 - protein, 3291 aa, Artificial Sequence
  derived and/or modified protein sequence (wt) from DENV-2__EU482733__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4188 - protein, 3291 aa, Artificial Sequence
  derived and/or modified protein sequence (wt) from DENV-2__EU482734__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIMITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIRNEEEEQTLTILIRTGLLVISGVFPVSIPVTAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPITMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4189 - protein, 3291 aa, Artificial Sequence
  derived and/or modified protein sequence (wt) from DENV-2__EU482735__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIMITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIRNEEEEQTLTILIRTGLLVISGVFPVSIPVTAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLTMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4190 - protein, 3291 aa, Artificial Sequence
  derived and/or modified protein sequence (wt) from DENV-2__EU482736__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVVVSFVTLITGNMSFRDLGRVMVMVGATMTDDIGMGITYLALLAAFKVRPTFAAGLLLRKLTSKELMMATIGIALLSQSTIPETILELTDALALSMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4191 - protein, 3291 aa, Artificial Sequence
  derived and/or modified protein sequence (wt) from DENV-2__EU482737__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVVVSFVTLITGNMSFRDLGRVMVMVGATMTDDIGMGITYLALLAAFKVRPTFAAGLLLRKLTSKELMMATIGIALLSQSTIPETILELTDALALSMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4192 - protein, 3291 aa, Artificial Sequence
  derived and/or modified protein sequence (wt) from DENV-2__EU482739__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNLEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4193 - protein, 3291 aa, Artificial Sequence
  derived and/or modified protein sequence (wt) from DENV-2__EU482740__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQPGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKRVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4194 - protein, 3291 aa, Artificial Sequence
  derived and/or modified protein sequence (wt) from DENV-2__EU482741__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVVVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4195 - protein, 3291 aa, Artificial Sequence
  derived and/or modified protein sequence (wt) from DENV-2__EU482742__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGAPEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4196 - protein, 3291 aa, Artificial Sequence
  derived and/or modified protein sequence (wt) from DENV-2__EU482744__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVSIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4197 - protein, 3291 aa, Artificial Sequence
  derived and/or modified protein sequence (wt) from DENV-2__EU482745__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNRTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTKESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVKSLIGNEEYTDYMPSMKRFRREEEEAGVLW

SEQ ID NO: 4198 - protein, 3291 aa, Artificial Sequence
  derived and/or modified protein sequence (wt) from DENV-2__EU482746__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNRTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4199 - protein, 3291 aa, Artificial Sequence
  derived and/or modified protein sequence (wt) from DENV-2__EU482590__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAVLGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPILDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNISLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4200 - protein, 3291 aa, Artificial Sequence
  derived and/or modified protein sequence (wt) from DENV-2__EU482594__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGITYLALLAAFKVRPTFAAGLLLKKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTEGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4201 - protein, 3291 aa, Artificial Sequence
  derived and/or modified protein sequence (wt) from DENV-2__EU482604__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4202 - protein, 3291 aa, Artificial Sequence
  derived and/or modified protein sequence (wt) from DENV-2__EU482605__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLVTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEANPEIEDAIFRKKRLTIMDLHPGAGKPKRSLPAIVREAIKRGLRPLILAPPRVVPAEMEEPLRGLPIRYQTPAIKPDHTGREIVALMCHAPFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKRLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4203 - protein, 3291 aa, Artificial Sequence
  derived and/or modified protein sequence (wt) from DENV-2__EU482606__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHPTFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4204 - protein, 3291 aa, Artificial Sequence
  derived and/or modified protein sequence (wt) from DENV-2__EU482607__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGVSNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSIIEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTDTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLALNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLTRVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4205 - protein, 3291 aa, Artificial Sequence
  derived and/or modified protein sequence (wt) from DENV-2__EU482608__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKRLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQIKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4206 - protein, 3291 aa, Artificial Sequence
  derived and/or modified protein sequence (wt) from DENV-2__EU687220__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPINIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDHAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLVRVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4207 - protein, 3291 aa, Artificial Sequence
  derived and/or modified protein sequence (wt) from DENV-2__EU726775__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFRTNTGTIGAISLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFRSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4208 - protein, 3291 aa, Artificial Sequence
  derived and/or modified protein sequence (wt) from DENV-2__FJ639732__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAVKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4209 - protein, 3291 aa, Artificial Sequence
  derived and/or modified protein sequence (wt) from DENV-2__FJ639733__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFEATMRGAKRMAILGDTAWDFGSLGGAFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRKMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4210 - protein, 3291 aa, Artificial Sequence
  derived and/or modified protein sequence (wt) from DENV-2__FJ639734__SS-prME
TAGVIVMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAAEVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRALVVPCRNQDELIGRARTSQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4211 - protein, 3291 aa, Artificial Sequence
  derived and/or modified protein sequence (wt) from DENV-2__JN819408__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDIFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFRTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESENNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIEGEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4212 - protein, 3291 aa, Artificial Sequence
  derived and/or modified protein sequence (wt) from DENV-2__FJ639783__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGVSNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4213 - protein, 3291 aa, Artificial Sequence
  derived and/or modified protein sequence (wt) from DENV-2__FJ639788__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTAGEHRREKRSVALVPHVGMGLETRTETWMSSEGAWKHVQRIETWILRHPGFTIMAAILAYTIGTTHFQRALIFILLTAVAPSMTMRCIGVSNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNYNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4214 - protein, 3291 aa, Artificial Sequence
  derived and/or modified protein sequence (wt) from DENV-2__FJ639822__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGVSNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSIIEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLALNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLTRVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4215 - protein, 3291 aa, Artificial Sequence
  derived and/or modified protein sequence (wt) from DENV-2__FJ850112__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGAFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRKMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4216 - protein, 3291 aa, Artificial Sequence
  derived and/or modified protein sequence (wt) from DENV-2__FJ850105__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGAEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4217 - protein, 3291 aa, Artificial Sequence
  derived and/or modified protein sequence (wt) from DENV-2__FJ850106__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVAASFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4218 - protein, 3291 aa, Artificial Sequence
  derived and/or modified protein sequence (wt) from DENV-2__FJ850107__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVFPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGKLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIRQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4219 - protein, 3291 aa, Artificial Sequence
  derived and/or modified protein sequence (wt) from DENV-2__FJ850108__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQIAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRMMVMVGATMTDDIGMGVTYLALLAAFKVRPTFVAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4220 - protein, 3291 aa, Artificial Sequence
  derived and/or modified protein sequence (wt) from DENV-2__JN819407__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSLGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLFTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4221 - protein, 3291 aa, Artificial Sequence
  derived and/or modified protein sequence (wt) from DENV-2__FJ898465__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMENYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDHAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4222 - protein, 3291 aa, Artificial Sequence
  derived and/or modified protein sequence (wt) from DENV-2__FJ898466__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQRAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDIFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFRTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKRKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRSQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4223 - protein, 3291 aa, Artificial Sequence
  derived and/or modified protein sequence (wt) from DENV-2__FJ898467__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4224 - protein, 3291 aa, Artificial Sequence
  derived and/or modified protein sequence (wt) from DENV-2__GQ868595__SS-prME
TAGVIIMLIPTAMAFHLTTRNGEPHMIVSRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMRGEHKKLAEAIFKLTYQNKVVRVQRPTPRGTVMDIISRRDQRGSGQVGTYGLNTFTNMEAQLIRQMEGEGIFKSIKHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4225 - protein, 3291 aa, Artificial Sequence
  derived and/or modified protein sequence (wt) from DENV-2__GQ868540__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLVDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENMEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4226 - protein, 3291 aa, Artificial Sequence
  derived and/or modified protein sequence (wt) from DENV-2__GQ868541__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDHAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHHDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4227 - protein, 3291 aa, Artificial Sequence
  derived and/or modified protein sequence (wt) from DENV-2__GQ868603__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVLCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLAAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLVVTIMAISCVPNAVILQNAWKVSCTILAAVSVSPLLLTSSRQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFFTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKIPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4228 - protein, 3291 aa, Artificial Sequence
  derived and/or modified protein sequence (wt) from DENV-2__FJ898450__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDAFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYRTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4229 - protein, 3291 aa, Artificial Sequence
  derived and/or modified protein sequence (wt) from DENV-2__FJ898453__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLRERQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGVYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVAPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4230 - protein, 3291 aa, Artificial Sequence
  derived and/or modified protein sequence (wt) from DENV-2__EU482445__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTLKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4231 - protein, 3291 aa, Artificial Sequence
  derived and/or modified protein sequence (wt) from DENV-2__EU482446__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4232 - protein, 3291 aa, Artificial Sequence
  derived and/or modified protein sequence (wt) from DENV-2__EU482448__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHEISWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4233 - protein, 3291 aa, Artificial Sequence
  derived and/or modified protein sequence (wt) from DENV-2__EU482449__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSNTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMFCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4234 - protein, 3291 aa, Artificial Sequence
  derived and/or modified protein sequence (wt) from DENV-2__EU482450__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSAIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYADYMPSMKRFRREEEEAGVLW

SEQ ID NO: 4235 - protein, 3291 aa, Artificial Sequence
  derived and/or modified protein sequence (wt) from DENV-2__EU569721__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPLPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4236 - protein, 3291 aa, Artificial Sequence
  derived and/or modified protein sequence (wt) from DENV-2__EU482451__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITGAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTKTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGNESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4237 - protein, 3291 aa, Artificial Sequence
  derived and/or modified protein sequence (wt) from DENV-2__EU660413__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGFDFNEMVLLQMENKAWLVHRQWFLDLPLPWLPGADKQESNWIQKETLVTFKNPHAKKQDVVILGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLSPTAIFLTTLSRSNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGGIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEKPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4238 - protein, 3291 aa, Artificial Sequence
  derived and/or modified protein sequence (wt) from DENV-2__EU660414__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGNRDPFPQSNAPIIDEEREIPERSWNSGHEWVTDFKGKTVWFVPSIKAGNDIAACLRKNGKKVIQLSRKTFDSEYVKTRINDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGSPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4239 - protein, 3291 aa, Artificial Sequence
  derived and/or modified protein sequence (wt) from DENV-2__EU660415__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVGPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRLGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKGIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANVICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4240 - protein, 3291 aa, Artificial Sequence
  derived and/or modified protein sequence (wt) from DENV-2__EU687249__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAREEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFMTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGRVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWSDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4241 - protein, 3291 aa, Artificial Sequence
  derived and/or modified protein sequence (wt) from DENV-2__EU660416__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLERRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGMKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNKVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4242 - protein, 3291 aa, Artificial Sequence
  derived and/or modified protein sequence (wt) from DENV-2__EU660417__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLERRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGSPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNKVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4243 - protein, 3291 aa, Artificial Sequence
  derived and/or modified protein sequence (wt) from DENV-2__EU677137__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVTVTEDCGSRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTVKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEAMQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4244 - protein, 3291 aa, Artificial Sequence
  derived and/or modified protein sequence (wt) from DENV-2__EU677138__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGRAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4245 - protein, 3291 aa, Artificial Sequence
  derived and/or modified protein sequence (wt) from DENV-2__EU677149__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLERRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNKVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4246 - protein, 3291 aa, Artificial Sequence
  derived and/or modified protein sequence (wt) from DENV-2__FJ024452__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGGHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTGKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRINDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKVRKDIQQWEPSKGWNDWTQVPFCSHHFHELIMKDGRVLVVPCRNQDELIARARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4247 - protein, 3291 aa, Artificial Sequence
  derived and/or modified protein sequence (wt) from DENV-2__FJ205877__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLERRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYPDRRWCFDGIKNNQILEENVEVEIWPKEGERKKLKPRWLDPRIYSEPRALKEFKEFPPGRKSLTLNLITEMGRLPTFMTQKTRDALDNLAGLHTAEAGGRADNHALSELAETLETLLLLTLLATGTGGIFLFLMSGRGIGKMTLGMCCIITASILLWDAQIQPHWIAASIILEFFLIVLLIPEPEKQRTPQDNQLTYVVIAILTVVGATMPNEMGFLEKTKKDLGLGSIATQQPESNILDIDLRPASAWTLYAVATTFVTPMLRHSIENSSVNVSLTAIANQATVLMGLGKGWALAKMDIGVPLLGIGCYSQVNPITLTGALLLLGGHYAIIGPGLQAKATREAQKRAAPGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCARGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQDPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKASRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVATYGLNTFTNMEAQLIRQMEGEGVFKNIQHLTVTEEVAVQNWLARVGRERLPRMAISGDDCVVKPLDARFANALTALNAMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNKVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4248 - protein, 3291 aa, Artificial Sequence
  derived and/or modified protein sequence (wt) from DENV-2__FJ024454__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGPVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIENNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWPKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVTGVVRLLTKPWDVLPTVTQMAMTDTTPFGQQRVFKEKVDTRTQDPKEATKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLPVTEEVAVQNWLARVGRERLSRMPISGDDCVVKPLDARFPTALTPLNDMGKIRKDIHQWDPSKGWNDWTQVPFCSHHFHELIMKDGRVLVVPCRNQDDLIARARISQGPGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4249 - protein, 3291 aa, Artificial Sequence
  derived and/or modified protein sequence (wt) from DENV-2__FJ205878__SS-prME
SAGMIIMLIPTVTAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYREGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGTESEIPNLDIIGKRIEKIKQEHETSWHYDQDHPYKTWAYHGSYETKQTGSASSMVNGVVRLLTKPWDVLPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4250 - protein, 3291 aa, Artificial Sequence
  derived and/or modified protein sequence (wt) from DENV-2__FJ205879__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCITTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNPRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4251 - protein, 3291 aa, Artificial Sequence
  derived and/or modified protein sequence (wt) from DENV-2__FJ390385__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIATEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVGCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRSEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGTESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4252 - protein, 3291 aa, Artificial Sequence
  derived and/or modified protein sequence (wt) from DENV-2__FJ024458__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGRRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMDYWIESALNDTWKIEKASFIEVKNCHWAKSHTLWSNGVLESEMIIPKNLAGPVSQHNYRLGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4253 - protein, 3291 aa, Artificial Sequence
  derived and/or modified protein sequence (wt) from DENV-2__FJ205880__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDASCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4254 - protein, 3291 aa, Artificial Sequence
  derived and/or modified protein sequence (wt) from DENV-2__FJ390387__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKVPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELVGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4255 - protein, 3291 aa, Artificial Sequence
  derived and/or modified protein sequence (wt) from DENV-2__FJ024461__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRLGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKGIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4256 - protein, 3291 aa, Artificial Sequence
  derived and/or modified protein sequence (wt) from DENV-2__FJ373299__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSRLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAGGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4257 - protein, 3291 aa, Artificial Sequence
  derived and/or modified protein sequence (wt) from DENV-2__FJ410193__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCITTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPAPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4258 - protein, 3291 aa, Artificial Sequence
  derived and/or modified protein sequence (wt) from DENV-2__FJ410195__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVIVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLLPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4259 - protein, 3291 aa, Artificial Sequence
  derived and/or modified protein sequence (wt) from DENV-2__FJ432726__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPASQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4260 - protein, 3291 aa, Artificial Sequence
  derived and/or modified protein sequence (wt) from DENV-2__JF730049__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHVVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILTENEVKLTIMTGDIKGIMQAGKRSLRPQPTELKYSWKTWGKAKMFSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLRIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGIEEYTDYMPSMKRFRREEEEAGVLW

SEQ ID NO: 4261 - protein, 3291 aa, Artificial Sequence
  derived and/or modified protein sequence (wt) from DENV-2__FJ562098__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIATEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPIELKYSWKTWGKAKMLSTESHNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMVIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4262 - protein, 3291 aa, Artificial Sequence
  derived and/or modified protein sequence (wt) from DENV-2__FJ859028__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKNNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4263 - protein, 3291 aa, Artificial Sequence
  derived and/or modified protein sequence (wt) from DENV-2__FJ410200__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFNFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIENNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATRQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRRCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4264 - protein, 3291 aa, Artificial Sequence
  derived and/or modified protein sequence (wt) from DENV-2__FJ410202__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEVWTKEGERKKLKPRWLDARIYSDPLALKEFKEFAAGRKSLTLNLITEMGRLPTFMTQKTRDALDNLAVLHTAEVGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYIDYMPSMKRFRREEEEAGVLW

SEQ ID NO: 4265 - protein, 3291 aa, Artificial Sequence
  derived and/or modified protein sequence (wt) from DENV-2__FJ410208__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFNFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATRQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMIETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4266 - protein, 3291 aa, Artificial Sequence
  derived and/or modified protein sequence (wt) from DENV-2__FJ461305__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQIDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKRATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4267 - protein, 3291 aa, Artificial Sequence
  derived and/or modified protein sequence (wt) from DENV-2__FJ410215__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGAAMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4268 - protein, 3291 aa, Artificial Sequence
  derived and/or modified protein sequence (wt) from DENV-2__FJ461309__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4269 - protein, 3291 aa, Artificial Sequence
  derived and/or modified protein sequence (wt) from DENV-2__FJ461311__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFNFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATRQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSQLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4270 - protein, 3291 aa, Artificial Sequence
  derived and/or modified protein sequence (wt) from DENV-2__FJ410217__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCIVSWKNKELKCGSGIFVTDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGIFGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILADGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNARRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4271 - protein, 3291 aa, Artificial Sequence
  derived and/or modified protein sequence (wt) from DENV-2__FJ410219__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEILMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRFLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGMKHAILLVAVSFVTLITGNMSFKDLGRVVVMVGATMTDDIGMGVTYLALLAAFKVRPTFAAGLLLRKLTSKELMMITIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERVTDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4272 - protein, 3291 aa, Artificial Sequence
  derived and/or modified protein sequence (wt) from DENV-2__FJ461314__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTLKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNTLGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4273 - protein, 3291 aa, Artificial Sequence
  derived and/or modified protein sequence (wt) from DENV-2__FJ410221__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGAIMADDIGIGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQSEKSIEDNPEIEDDIFRKRRLTIMDLHPGAGKTKRYLPAIVREAIKRGLRTLILAPTRVVAAEMEEALRGLPIRYQTPAIRVEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNVGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4274 - protein, 3291 aa, Artificial Sequence
  derived and/or modified protein sequence (wt) from DENV-2__FJ547064__SS-prME
SAGMIIMLIPTVMAFHLTTRNGEPHMVVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYREGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIVACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNIQFCIKVLNPYMPSVIEKMEALQRKYGGALVRNPLSRNSTHEMYWVSNASGNIVSSVNMISRMLINRFTMRHKKATYEPDVDLGSGTRNIGTESEIPNLDIIGKRIEKIKQEHETSWHYDQDHPYKTWAYHGSYETKQTGSASSMVNGVVRLLTKPWDVLPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4275 - protein, 3291 aa, Artificial Sequence
  derived and/or modified protein sequence (wt) from DENV-2__FJ410223__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWRTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLALLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSGNLKNEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLVANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4276 - protein, 3291 aa, Artificial Sequence
  derived and/or modified protein sequence (wt) from DENV-2__FJ410224__SS-prME
SAGMIIMLIPTVMAFHLTTRNGEPHMIVGIQEKGKSLLFKTEDGVNMCTLMAMDLGELCEDTVTYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGTVTLYLGVMVQADSGCVVSWKSKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4277 - protein, 3291 aa, Artificial Sequence
  derived and/or modified protein sequence (wt) from DENV-2__FJ461321__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHSVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATNVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLESDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4278 - protein, 3291 aa, Artificial Sequence
  derived and/or modified protein sequence (wt) from DENV-2__FJ410228__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFNGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4279 - protein, 3291 aa, Artificial Sequence
  derived and/or modified protein sequence (wt) from DENV-2__FJ410233__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFNFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATRQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4280 - protein, 3291 aa, Artificial Sequence
  derived and/or modified protein sequence (wt) from DENV-2__FJ410237__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWIDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYADYMPSMKRFRREEEEAGVLW

SEQ ID NO: 4281 - protein, 3291 aa, Artificial Sequence
  derived and/or modified protein sequence (wt) from DENV-2__FJ410241__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLRIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQLESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4282 - protein, 3291 aa, Artificial Sequence
  derived and/or modified protein sequence (wt) from DENV-2__FJ410259__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSTTEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLAAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4283 - protein, 3291 aa, Artificial Sequence
  derived and/or modified protein sequence (wt) from DENV-2__FJ547067__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAISFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAAVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEEQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQVYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGRKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4284 - protein, 3291 aa, Artificial Sequence
  derived and/or modified protein sequence (wt) from DENV-2__JN819418__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4285 - protein, 3291 aa, Artificial Sequence
  derived and/or modified protein sequence (wt) from DENV-2__EU482640__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTTVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWRQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMTTIGIVLLSQSTVPETILELTDALALGMMVLKIVRNMEKYQLAVTIMAILCVPNAVILQNAWKVSCTTLAVVSVSPLLLTSSRQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSMRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4286 - protein, 3291 aa, Artificial Sequence
  derived and/or modified protein sequence (wt) from DENV-2__EU482641__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTITGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4287 - protein, 3291 aa, Artificial Sequence
  derived and/or modified protein sequence (wt) from DENV-2__EU482642__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVFELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRICTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRKDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4288 - protein, 3291 aa, Artificial Sequence
  derived and/or modified protein sequence (wt) from DENV-2__EU482643__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMKNKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVTVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRDNPWMEDKTPVESWEEIPYLGKREDQWCGSLIGLTSRATWAKNIQAAINQVRSLMGNEEYTDYMPSMKRFRREEEEAGVLW

SEQ ID NO: 4289 - protein, 3291 aa, Artificial Sequence
  derived and/or modified protein sequence (wt) from DENV-2__EU482644__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGTGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4290 - protein, 3291 aa, Artificial Sequence
  derived and/or modified protein sequence (wt) from DENV-2__EU482645__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQKVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGTGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4291 - protein, 3291 aa, Artificial Sequence
  derived and/or modified protein sequence (wt) from DENV-2__EU482646__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCITTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4292 - protein, 3291 aa, Artificial Sequence
  derived and/or modified protein sequence (wt) from DENV-2__EU482647__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMKNKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4293 - protein, 3291 aa, Artificial Sequence
  derived and/or modified protein sequence (wt) from DENV-2__EU482648__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4294 - protein, 3291 aa, Artificial Sequence
  derived and/or modified protein sequence (wt) from DENV-2__EU482649__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVSYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQNLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4295 - protein, 3291 aa, Artificial Sequence
  derived and/or modified protein sequence (wt) from DENV-2__EU482650__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGKFWNTTIAVSMANIFRGSYLAGAGLLFSIMKNTTNTRRGTGNMGETLGEKWKSRLNTLGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4296 - protein, 3291 aa, Artificial Sequence
  derived and/or modified protein sequence (wt) from DENV-2__EU482651__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVTVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4297 - protein, 3291 aa, Artificial Sequence
  derived and/or modified protein sequence (wt) from DENV-2__EU482652__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSLCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSAIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASTLLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYADYMPSMKRFRREEEEAGVLW

SEQ ID NO: 4298 - protein, 3291 aa, Artificial Sequence
  derived and/or modified protein sequence (wt) from DENV-2__EU482653__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGIFGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNARRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4299 - protein, 3291 aa, Artificial Sequence
  derived and/or modified protein sequence (wt) from DENV-2__EU482654__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKMTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNTLGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4300 - protein, 3291 aa, Artificial Sequence
  derived and/or modified protein sequence (wt) from DENV-2__EU482656__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPILDEEREIPERSWNSGHEWVTDFEGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSVATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4301 - protein, 3291 aa, Artificial Sequence
  derived and/or modified protein sequence (wt) from DENV-2__EU482657__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWIMRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWMESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASTLLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHEASWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4302 - protein, 3291 aa, Artificial Sequence
  derived and/or modified protein sequence (wt) from DENV-2__EU482658__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVIVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVTVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRDNPWMEDKTPVESWEEIPYLGKREDQWCGSLIGLTSRATWAKNIQAAINQVRSLIGNEEYTDYMPSMKRFRREEEEAGVLW

SEQ ID NO: 4303 - protein, 3291 aa, Artificial Sequence
  derived and/or modified protein sequence (wt) from DENV-2__EU482659__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKHGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGDEEYTDYMPSMKRFRREEEEAGVLW

SEQ ID NO: 4304 - protein, 3291 aa, Artificial Sequence
  derived and/or modified protein sequence (wt) from DENV-2__EU482661__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEGDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4305 - protein, 3291 aa, Artificial Sequence
  derived and/or modified protein sequence (wt) from DENV-2__EU482662__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4306 - protein, 3291 aa, Artificial Sequence
  derived and/or modified protein sequence (wt) from DENV-2__EU482663__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLRNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYIDYMPSMKRFRREEEEAGVLW

SEQ ID NO: 4307 - protein, 3291 aa, Artificial Sequence
  derived and/or modified protein sequence (wt) from DENV-2__EU482664__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSVATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4308 - protein, 3291 aa, Artificial Sequence
  derived and/or modified protein sequence (wt) from DENV-2__EU482665__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4309 - protein, 3291 aa, Artificial Sequence
  derived and/or modified protein sequence (wt) from DENV-2__EU482666__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMATIGIALLSQSTIPETILELTDALALGMMVLKIMRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4310 - protein, 3291 aa, Artificial Sequence
  derived and/or modified protein sequence (wt) from DENV-2__EU482667__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKEALVTFKNPHAKKQDVVVLGSQEGAMHTALTGATEIQMSSGNLLFTGHLKCRLRMDKLQLKGMSYSMCTGKFKVVKEIAETQHGTIVIKVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4311 - protein, 3291 aa, Artificial Sequence
  derived and/or modified protein sequence (wt) from DENV-2__EU482668__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4312 - protein, 3291 aa, Artificial Sequence
  derived and/or modified protein sequence (wt) from DENV-2__EU482669__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSAWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEVELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDYKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKTIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4313 - protein, 3291 aa, Artificial Sequence
  derived and/or modified protein sequence (wt) from DENV-2__EU482670__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVMKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQVAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4314 - protein, 3291 aa, Artificial Sequence
  derived and/or modified protein sequence (wt) from DENV-2__EU482671__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVREIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4315 - protein, 3291 aa, Artificial Sequence
  derived and/or modified protein sequence (wt) from DENV-2__EU482674__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGHSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKNIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEKPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4316 - protein, 3291 aa, Artificial Sequence
  derived and/or modified protein sequence (wt) from DENV-2__EU482676__SS-prME
SASMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIKAKLTNTTTESRCPTQGEPSLKEEQDKRFVCKHSMVDRGWGNGCGLFGKGGIVTCAMFTCKKNMEGRIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDVFCDSKLMSAAIKDNRAVHADMGYWIESALNDTWKIERASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLRNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLAVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4317 - protein, 3291 aa, Artificial Sequence
  derived and/or modified protein sequence (wt) from DENV-2__EU482677__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTKTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGNESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4318 - protein, 3291 aa, Artificial Sequence
  derived and/or modified protein sequence (wt) from DENV-2__EU482678__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADEQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALAIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4319 - protein, 3291 aa, Artificial Sequence
  derived and/or modified protein sequence (wt) from DENV-2__EU482679__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMGTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4320 - protein, 3291 aa, Artificial Sequence
  derived and/or modified protein sequence (wt) from DENV-2__EU482774__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKIFIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAKWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4321 - protein, 3291 aa, Artificial Sequence
  derived and/or modified protein sequence (wt) from DENV-2__EU482775__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4322 - protein, 3291 aa, Artificial Sequence
  derived and/or modified protein sequence (wt) from DENV-2__EU482776__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAYKVRPTFAAGLLLRKLTSKELMMTTIGIVLLSQSTIPETVLELTDALALGMMVLKIVRNMEKYQLAVTIMAILCVPNAVILQNAWKASCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRILNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHEASWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGCERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWILENPWMEDKTPVESWEEIPYLGKREDQWCGSLIGLTSRATWAKNIQAAINQVRSLIGNEEYTDYMPSMKRFRREEEEAGVLW

SEQ ID NO: 4323 - protein, 3291 aa, Artificial Sequence
  derived and/or modified protein sequence (wt) from DENV-2__EU482777__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4324 - protein, 3291 aa, Artificial Sequence
  derived and/or modified protein sequence (wt) from DENV-2__EU482778__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKNCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGIGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPVPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4325 - protein, 3291 aa, Artificial Sequence
  derived and/or modified protein sequence (wt) from DENV-2__EU482779__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4326 - protein, 3291 aa, Artificial Sequence
  derived and/or modified protein sequence (wt) from DENV-2__EU482780__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRMLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4327 - protein, 3291 aa, Artificial Sequence
  derived and/or modified protein sequence (wt) from DENV-2__EU482781__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQPGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWKLVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4328 - protein, 3291 aa, Artificial Sequence
  derived and/or modified protein sequence (wt) from DENV-2__EU482782__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFVAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4329 - protein, 3291 aa, Artificial Sequence
  derived and/or modified protein sequence (wt) from DENV-2__EU482783__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGGIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4330 - protein, 3291 aa, Artificial Sequence
  derived and/or modified protein sequence (wt) from DENV-2__EU482784__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4331 - protein, 3291 aa, Artificial Sequence
  derived and/or modified protein sequence (wt) from DENV-2__EU482785__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVEKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4332 - protein, 3291 aa, Artificial Sequence
  derived and/or modified protein sequence (wt) from DENV-2__EU482786__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDGDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAKWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4333 - protein, 3291 aa, Artificial Sequence
  derived and/or modified protein sequence (wt) from DENV-2__EU482787__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTSTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4334 - protein, 3291 aa, Artificial Sequence
  derived and/or modified protein sequence (wt) from DENV-2__EU482788__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4335 - protein, 3291 aa, Artificial Sequence
  derived and/or modified protein sequence (wt) from DENV-2__EU482697__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYREGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGTESEIPNLDIIGKRIEKIKQEHETSWHYDQDHPYKTWAYHGSYETKQTGSASSMVNGVVRLLTKPWDVLPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNFHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4336 - protein, 3291 aa, Artificial Sequence
  derived and/or modified protein sequence (wt) from DENV-2__EU482699__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGILGMALFLEEMLRTRVGTKHAILLAAVSFVTLITGNMSFKDLGRVMVMVGATMADDIGMGVTYLALLAAFKVRPTFAAGLLLRRLTSKELMMTTIGIVLLSQSTIPETVLELTDALALGMMVLKIVRKMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKGGEKKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4337 - protein, 3291 aa, Artificial Sequence
  derived and/or modified protein sequence (wt) from DENV-2__EU482701__SS-prME
SAGMIIMLIPTVMAFHLTTRNGEPHMIVGIQEKGKSLLFKTEDGVNMCTLMAMDLGELCEDTITYKCPLLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHAALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLRLKEKQDAFCDSKLMSAAVKDNRAVHADMGYWIESALNDTWKIEKASFIEVKNCHWPKSHTLWSNGVLESEMVIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGILGMALFLEEMLRTRVGTKHAILLVAVSFVTLITGNMSFKDLGRVVVMVGATMADDIGMGVTYLALLAAFKVRPTFAAGLLLRKLTSKELMMTTIGVVLLSQSTIPDTVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4338 - protein, 3291 aa, Artificial Sequence
  derived and/or modified protein sequence (wt) from DENV-2__EU482703__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVGCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4339 - protein, 3291 aa, Artificial Sequence
  derived and/or modified protein sequence (wt) from DENV-2__EU482705__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADNIGMGVTYLALLAAFKVRPTFAAGLLLRRLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4340 - protein, 3291 aa, Artificial Sequence
  derived and/or modified protein sequence (wt) from DENV-2__EU482463__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEKPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4341 - protein, 3291 aa, Artificial Sequence
  derived and/or modified protein sequence (wt) from DENV-2__EU482464__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALAALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4342 - protein, 3291 aa, Artificial Sequence
  derived and/or modified protein sequence (wt) from DENV-2__EU482465__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFICKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSTEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCITTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4343 - protein, 3291 aa, Artificial Sequence
  derived and/or modified protein sequence (wt) from DENV-2__EU482466__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPLPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4344 - protein, 3291 aa, Artificial Sequence
  derived and/or modified protein sequence (wt) from DENV-2__EU482467__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFKLTYQNKVVRVQRPTPRGTVMDIISRRDQRGSGQVGTYGLNTFTNMEAQLIRQMEGEGVFKNIHHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4345 - protein, 3291 aa, Artificial Sequence
  derived and/or modified protein sequence (wt) from DENV-2__EU482468__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWIMRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWMESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASTLLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4346 - protein, 3291 aa, Artificial Sequence
  derived and/or modified protein sequence (wt) from DENV-2__EU482469__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAHTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKNIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNTGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4347 - protein, 3291 aa, Artificial Sequence
  derived and/or modified protein sequence (wt) from DENV-2__EU482470__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMTILCVPNAVILQNAWKVSCTILAVVSVSPLLLTSSRQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4348 - protein, 3291 aa, Artificial Sequence
  derived and/or modified protein sequence (wt) from DENV-2__EU482471__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHSVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATNVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4349 - protein, 3291 aa, Artificial Sequence
  derived and/or modified protein sequence (wt) from DENV-2__EU482472__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWMESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGIIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4350 - protein, 3291 aa, Artificial Sequence
  derived and/or modified protein sequence (wt) from DENV-2__EU482473__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDRKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQVAINQVRSLIGNEEYTDYMPSMKRFRREEEEAGVLW

SEQ ID NO: 4351 - protein, 3291 aa, Artificial Sequence
  derived and/or modified protein sequence (wt) from DENV-2__EU482474__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPINIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLRLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIVTASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4352 - protein, 3291 aa, Artificial Sequence
  derived and/or modified protein sequence (wt) from DENV-2__EU482475__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYVDRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4353 - protein, 3291 aa, Artificial Sequence
  derived and/or modified protein sequence (wt) from DENV-2__EU482541__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPAELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQRLTVTEEVAVHNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4354 - protein, 3291 aa, Artificial Sequence
  derived and/or modified protein sequence (wt) from DENV-2__EU482542__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKVPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGTCGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLKTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4355 - protein, 3291 aa, Artificial Sequence
  derived and/or modified protein sequence (wt) from DENV-2__JX966380__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMKDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKTLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMVIPKNFAGPVSQHNNRPGYHTQTAGPWHLGKLEMDFDFCEGTTVVVTEDCGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFTAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGNIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKNIQHLTASEEIAVQDWLVRVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNKVWILENPWMEDKTPVESWEEIPYLGKREDQWCGSLIGLTSRATWAKNIQTAINQVRSLIGNEEYTDYMPSMKRFRREEEEAGVLW

SEQ ID NO: 4356 - protein, 3291 aa, Artificial Sequence
  derived and/or modified protein sequence (wt) from DENV-2__JX966379__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRRGKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPASLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMVIPKNYAGPVSQHNNRPGYHTQTAGPWHLGKLEMDFDFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRSRVGTKHAILLVAVSFVTLITGNMSFRDLGRVMVMVGATMTDDIGMGVTYLALLAAYKVRPTFAAGLLLRKLTSKELMMTTIGIVLLSQSSIPETILELTDALALGMMVLKMVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSTPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIATCLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVASEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGHIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNDNTQFCVKVLNPYMPSVIERMETLQRKYGGALVRNPLSRNSTHEMYWVSNASGNVVSSVNMISRMLINRFTMRHKKATYEPDVDLGSGTRNIGIESETPNLDIIGKRIEKIKQEHEASWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDNRFWELVDKERNLHLEGKCETCVYNMMGKREKKLGEFGKARGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVVTYGLNTFTNMEAQLIRQMEGEGIFKSIQHLTASEEIAVQDWLARVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 4357 - protein, 3291 aa, Artificial Sequence
  derived and/or modified protein sequence (wt) from DENV-2__KP012546__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGMGVTYLALLAAFKVRPTFAAGLLLRKLTSKELMMTTIGIVLLSQSTMPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNISTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSTTTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWNLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4358 - protein, 3291 aa, Artificial Sequence
  derived and/or modified protein sequence (wt) from DENV-2__KP723478__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPMSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGMGVTYLALLAAFKVRPTFAAGLLLRKLTSKELMMTTIGIVLLSQSTMPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSTPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNISTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSTTTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWNLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4359 - protein, 3291 aa, Artificial Sequence
  derived and/or modified protein sequence (wt) from DENV-2__KP723479__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKMKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVVSGLFPVSTPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPENNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4360 - protein, 3291 aa, Artificial Sequence
  derived and/or modified protein sequence (wt) from DENV-2__KT187554__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGMGVTYLALLAAFKVRPTFAAGLLLRKLTSKELMMTTIGIVLLSQSTMPETILELTDALALGMMVLKIVRNMEKYQLAVTIMAILCVPNAVILQNAWKVSCTTLAVVSVSPLFLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNISTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSTTTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKREGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWNLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4361 - protein, 3291 aa, Artificial Sequence
  derived and/or modified protein sequence (wt) from DENV-2__KT187557__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPMSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGMGVTYLALLAAFKVRPTFAAGLLLRKLTSKELMMTTIGIVLLSQSTMPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNISTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSTTTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWNLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4362 - protein, 3291 aa, Artificial Sequence
  derived and/or modified protein sequence (wt) from DENV-2__JQ045670__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGAAMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNDLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4363 - protein, 3291 aa, Artificial Sequence
  derived and/or modified protein sequence (wt) from DENV-2__JQ045686__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAVILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGQEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIITGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFNFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIVGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRVTLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4364 - protein, 3291 aa, Artificial Sequence
  derived and/or modified protein sequence (wt) from DENV-2__KU094070__SS-prME
TAGMIIMLIPTVMAFHLTTRNGEPHMIVSRQEKGKSLLFKTEDGVNMCTLMAMDLGEWLEDKITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGSIVTCAMFTCKKIMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGYLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILTGVIITWIGMNSRSTSLSVSLVLVGAVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREEQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVTLAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRVTWGKNIQTAINQVRSLIGNEEYTDYMPSMKRFRREEEEAGVLW

SEQ ID NO: 4365 - protein, 3291 aa, Artificial Sequence
  derived and/or modified protein sequence (wt) from DENV-2__FM210215__SS-prME
SAGMIVMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELEKATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNSLGKSEFQIYKKSGIQEVDRTLAKEGIKRGETDHHAVSRGSAKLRWFVERNMVTPEGKVVDLGCGRGGWSYYCGGLKSVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4366 - protein, 3291 aa, Artificial Sequence
  derived and/or modified protein sequence (wt) from DENV-2__FM210216__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4367 - protein, 3291 aa, Artificial Sequence
  derived and/or modified protein sequence (wt) from DENV-2__FM210217__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGDHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGIGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSKDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4368 - protein, 3291 aa, Artificial Sequence
  derived and/or modified protein sequence (wt) from DENV-2__JX286524__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4369 - protein, 3291 aa, Artificial Sequence
  derived and/or modified protein sequence (wt) from DENV-2__JX286520__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGIVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4370 - protein, 3291 aa, Artificial Sequence
  derived and/or modified protein sequence (wt) from DENV-2__JX286525__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4371 - protein, 3291 aa, Artificial Sequence
  derived and/or modified protein sequence (wt) from DENV-2__KM279598__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDVGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4372 - protein, 3291 aa, Artificial Sequence
  derived and/or modified protein sequence (wt) from DENV-2__KM279576__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARTYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4373 - protein, 3291 aa, Artificial Sequence
  derived and/or modified protein sequence (wt) from DENV-2__KC964095__SS-prME
SAGMIIMLIPTVMAFHLTTRNGEPHMIVSIQEKGKSLLFKTEDGVNMCTLMAMDLGELCEDTITYKCPLLRQNEPEDIDRWCNSTSTWVTYGTCTTTGEHRREKRSVALVPHVGMGLETRTETWMSSEGAWKHAQRIETWILRHPGFTIMAAILAYTIGTTHFQRALIFILLTAVAPPMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSIVDRGWGNGCGSFGKGGIVTCAMFTCKKNMEGKIVQPENLEYTIVVTPHSGEEHAIGNDTGKHGKEIKVTPQSSVTEAELTGYGTVTIECSPRTGLDFNEMVLLQMGNKAWLVHRQWFLDLPLPWLPGADTQGSNWIQKETLVTFKNPHAKKQDVVVLGSQEGAMHTALTGATEIQMSSGNLLFTGHLKCGLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVRTWTEQYKFQPESPSKLASAIQKAQEEGICGIRSVTRLENLMWKQITPELNHILAENEVKLTIMTGDIKGTMQAGKRSLRPQPTELKYSWKTWGKAKMLSTESHNQTFLIDGPETAECPNTNRAWNSLEVEDYGFGMFTTNIWLQLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHQGKPEMDFDFCDGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETVLELTDALALGMMALKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVNWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGVLGYSQIGAGVYKEGTFHTMWHVTRGAVLMHKGKRIEPSWADVKKDLISYGGGWKLGGEWKEGEEVQVLALEPGKNPRAVQTKPGLFKTNTGTIGAVSLDFSPGTSGSPIIDKKGKVEGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLPPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGEWSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIGKIKQEHETSWHYDQDHPYKTWAYHGSYETKQTGSASSMVDGVVRLLTKPWDVIPMVTQMAMTDTTPFGQQRVFKEKVDTRTQEPKEGTKKLMKITAEWLWKELGKKETPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPPPRGTVMDIISRRDQRGSGQVVTYGLNTFTNMEAQLIRQMEGEGVFKNIQHLTVTEEIAVQNWLARVGRERLSRMAISGDDCVVKPLDDRFASALTALNDVGKIRKDIQQWEPSRGWDDWTQVPFCSHHSHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREGQWCGSLIGLTSRATWAKNIQTAINQVRSLIGNEEYTDYMPSMKRFRREEEEAGVLW

SEQ ID NO: 4374 - protein, 3291 aa, Artificial Sequence
  derived and/or modified protein sequence (wt) from DENV-2__KC964094__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWVLRHPGFTIMAAILAYTIGTTYFQRVLIFILLTAVAPSMTMRSIGISNRDFVEGVSGGSWVDVVLEHGSCVTTMAKNKPTLDFELTKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSVTEAELTGYGTVTMECSPRTGLDFNEMVLLQMKNKAWLVHRQWFLDLPLPWLPGADTQGSNWIQKETLVTFKNPHAKKQDVVVLGSQEGAMHTALTGATEIQMSSGNLLFTGHLKCRLRTDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKESSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAERPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLAGRSADLELERAADVRWEEQAEISGSSPILSITISEDGGMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEIQVLALEPGKNPRAVQTKPGLFKTNTGTIGAVSLDFSPGTSGSPIVDKKGKVVGLYGNGVVTRSGTYVSAIAQTEKSIEDNPEIEDDTFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGRKVIQLSRKTSDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVGNPLSRNSTHEMYWASNASGNIVSSVNMISRMLINRFTMRHKKATYEPDVDLGSGTRHIGIESETPNLDIIGKRIEKIKQEHETSWHCDQDHPYKTWAYHGSYEAKQTGSASSMVNGVVRLLTKPWDVIPMVTQMAMTDTTPFGQQRVFKEKVDTRTQEPKEGTKKLMKITAEWLWKELGKKKAPRMCTREEFTRKVRSNAALGAMFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4375 - protein, 3291 aa, Artificial Sequence
  derived and/or modified protein sequence (wt) from DENV-2__KC964093__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELTKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENVVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKAVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSSRDLGRVMVMVGATMTDDIGMGVTYLALLAAFKVRPTFAAGLLLRKLTSKELMMTTIGIVLLSQSSIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLAGRSADLELERAADVRWEEQAEISGSSPILSITISEDGGMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEIQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPERERVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDDLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVAIAILTVVAATMANEMGFLEKTKKDFGLGSIATQQPESNILDLDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGVGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFAPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLTRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEGEAGVLW

SEQ ID NO: 4376 - protein, 3291 aa, Artificial Sequence
  derived and/or modified protein sequence (wt) from DENV-2__DQ448231__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENTVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKILSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 4377 - protein, 3291 aa, Artificial Sequence
  derived and/or modified protein sequence (wt) from DENV-2__JX470186__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLAHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKMKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVVSGLFPVSTPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPENNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4378 - protein, 3291 aa, Artificial Sequence
  derived and/or modified protein sequence (wt) from DENV-2__KU517846__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFMTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEELTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLSPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4379 - protein, 3291 aa, Artificial Sequence
  derived and/or modified protein sequence (wt) from DENV-2__KJ830750__SS-prME
TAGVIIMLIPTAMAFHLTTRNGEPHMIVSKQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTGKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPESILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELEKAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIAIQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAGHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 4380 - protein, 3291 aa, Artificial Sequence
  derived and/or modified protein sequence (wt) from DENV-2__FM210231__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIVTQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKSVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4381 - protein, 3291 aa, Artificial Sequence
  derived and/or modified protein sequence (wt) from DENV-2__FM210239__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARRTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4382 - protein, 3291 aa, Artificial Sequence
  derived and/or modified protein sequence (wt) from DENV-2__FM210232__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEACGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4383 - protein, 3291 aa, Artificial Sequence
  derived and/or modified protein sequence (wt) from DENV-2__FM210233__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIRGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWMESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKRDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4384 - protein, 3291 aa, Artificial Sequence
  derived and/or modified protein sequence (wt) from DENV-2__FM210241__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLSLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQFIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4385 - protein, 3291 aa, Artificial Sequence
  derived and/or modified protein sequence (wt) from DENV-2__FM210242__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVVLQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKSVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4386 - protein, 3291 aa, Artificial Sequence
  derived and/or modified protein sequence (wt) from DENV-2__FM210243__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVFPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4387 - protein, 3291 aa, Artificial Sequence
  derived and/or modified protein sequence (wt) from DENV-2__FM210244__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGIGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSKDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEMPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4388 - protein, 3291 aa, Artificial Sequence
  derived and/or modified protein sequence (wt) from DENV-2__FM210234__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGIALFLEEMLRTRVGTKHAILLVAVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4389 - protein, 3291 aa, Artificial Sequence
  derived and/or modified protein sequence (wt) from DENV-2__FM210213__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4390 - protein, 3291 aa, Artificial Sequence
  derived and/or modified protein sequence (wt) from DENV-2__FM210235__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCRHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLEWSIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATREPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4391 - protein, 3291 aa, Artificial Sequence
  derived and/or modified protein sequence (wt) from DENV-2__FM210205__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLKKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4392 - protein, 3291 aa, Artificial Sequence
  derived and/or modified protein sequence (wt) from DENV-2__FM210206__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSIESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4393 - protein, 3291 aa, Artificial Sequence
  derived and/or modified protein sequence (wt) from DENV-2__FM210246__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESFNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4394 - protein, 3291 aa, Artificial Sequence
  derived and/or modified protein sequence (wt) from DENV-2__FM210207__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSMHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4395 - protein, 3291 aa, Artificial Sequence
  derived and/or modified protein sequence (wt) from DENV-2__FM210238__SS-prME
TAGMIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNDQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4396 - protein, 3291 aa, Artificial Sequence
  derived and/or modified protein sequence (wt) from DENV-2__FM210224__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGAKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4397 - protein, 3291 aa, Artificial Sequence
  derived and/or modified protein sequence (wt) from DENV-2__FM210225__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4398 - protein, 3291 aa, Artificial Sequence
  derived and/or modified protein sequence (wt) from DENV-2__FM210226__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGAAMTDDIGIGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILATVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWHAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPVPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4399 - protein, 3291 aa, Artificial Sequence
  derived and/or modified protein sequence (wt) from DENV-2__FM210227__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSVTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESTLNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMILKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNFGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSVATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMGGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHDLIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4400 - protein, 3291 aa, Artificial Sequence
  derived and/or modified protein sequence (wt) from DENV-2__FM210204__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSVTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGAIITWIGMNSRSTSLSVSLVLVGVITLYLGAMVQADSGCVVSWKNKELKCGSGIFITDNVHTWTEQYKFQPESPSKLASAIQKAYEEGICGIRSVTRLENLMWKQITPELNHILSENEVKLTIMTGDIKGIMQAGKRSLRPQPTELKYSWKTWGKAKMLSTESHNQTFLIDGLETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSVATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPPVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSKGWNDWTQVPFCSHHFHDLIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4401 - protein, 3291 aa, Artificial Sequence
  derived and/or modified protein sequence (wt) from DENV-2__FM210230__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTVGTTHFQRALIFILLAAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSPITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVTVSFVTLITGNMSFRDLGRVMVMVGAAMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPMLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITIAEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGVTVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRICTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKGGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQRLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4402 - protein, 3291 aa, Artificial Sequence
  derived and/or modified protein sequence (wt) from DENV-2__KC762665__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVAPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4403 - protein, 3291 aa, Artificial Sequence
  derived and/or modified protein sequence (wt) from DENV-2__KC762669__SS-prME
TAGIIIMVIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGIIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQLESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFRLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4404 - protein, 3291 aa, Artificial Sequence
  derived and/or modified protein sequence (wt) from DENV-2__KC762658__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTAPGEHRREKRSVALVPHVGMGLETRTETWMSSEGAGKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKLPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVELMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEKYTDYMPSMKRFRREEEEAGVLW

SEQ ID NO: 4405 - protein, 3291 aa, Artificial Sequence
  derived and/or modified protein sequence (wt) from DENV-2__KC762660__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFIDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLQETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4406 - protein, 3291 aa, Artificial Sequence
  derived and/or modified protein sequence (wt) from DENV-2__KC762676__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVYCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVSLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYRTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4407 - protein, 3291 aa, Artificial Sequence
  derived and/or modified protein sequence (wt) from DENV-2__KC762662__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVTVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4408 - protein, 3291 aa, Artificial Sequence
  derived and/or modified protein sequence (wt) from DENV-2__KC762661__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYQTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4409 - protein, 3291 aa, Artificial Sequence
  derived and/or modified protein sequence (wt) from DENV-2__KC762655__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAVYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNKAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITATAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERSLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGIVMDIISRRDQRGSGQVVTYGLNTFTNMEAQLIRQMEGEGVFKSIQQLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWARNIQTAINQVRSLIGNEEYTDYMPSMKRFRREEEEAGVLW

SEQ ID NO: 4410 - protein, 3291 aa, Artificial Sequence
  derived and/or modified protein sequence (wt) from DENV-2__KC762656__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRAETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGTIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCQWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVVSGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4411 - protein, 3291 aa, Artificial Sequence
  derived and/or modified protein sequence (wt) from DENV-2__KC762673__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTPLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVYCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYRTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4412 - protein, 3291 aa, Artificial Sequence
  derived and/or modified protein sequence (wt) from DENV-2__KC762663__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEITDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVEKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVTVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4413 - protein, 3291 aa, Artificial Sequence
  derived and/or modified protein sequence (wt) from DENV-2__KC762675__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVYCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIQQEHETSWHYDQDHPYRTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKKEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4414 - protein, 3291 aa, Artificial Sequence
  derived and/or modified protein sequence (wt) from DENV-2__KC762671__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSMKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4415 - protein, 3291 aa, Artificial Sequence
  derived and/or modified protein sequence (wt) from DENV-2__KC762664__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEITDLEKRHGLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVEKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGKAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVTVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVGSWEEIPYLGKREDQWCGSLIGLTSRATWAKNIQTAINQVRSLIGNEEYTDYMPSMKRFRREEEEAGVLW

SEQ ID NO: 4416 - protein, 3291 aa, Artificial Sequence
  derived and/or modified protein sequence (wt) from DENV-2__KC762674__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVYCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4417 - protein, 3291 aa, Artificial Sequence
  derived and/or modified protein sequence (wt) from DENV-2__KC762672__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWENKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNAGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSMKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4418 - protein, 3291 aa, Artificial Sequence
  derived and/or modified protein sequence (wt) from DENV-2__KC762667__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGVTLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKREHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4419 - protein, 3291 aa, Artificial Sequence
  derived and/or modified protein sequence (wt) from DENV-2__KC762659__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWMESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRRLTSKELMMTTIGIVLLSQSTIPETILELTDALALGMMVLKIVRKMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQSESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4420 - protein, 3291 aa, Artificial Sequence
  derived and/or modified protein sequence (wt) from DENV-2__KC762657__SS-prME
TAGIIIMMIPTVMVFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWMESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRRLTSKELMMTTIGIVLLSQSTIPETILELTDALALGMMVLKIVRKMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQSESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTATEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4421 - protein, 3291 aa, Artificial Sequence
  derived and/or modified protein sequence (wt) from DENV-2__KC762666__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKREHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4422 - protein, 3291 aa, Artificial Sequence
  derived and/or modified protein sequence (wt) from DENV-2__KC762677__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVYCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPMKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYRTWAYHGSYENKQTGSASSMVNGVVRLLTKPWDVIPMVTQMAMTDTTPFGQQRVFKEKVDTRTQEPKEGTKKLMKITAEWLWKELGKKKTPRMCTRKEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4423 - protein, 3291 aa, Artificial Sequence
  derived and/or modified protein sequence (wt) from DENV-2__KC762668__SS-prME
TAGIIIMVIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGIIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQLESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKRLAEAIFRLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4424 - protein, 3291 aa, Artificial Sequence
  derived and/or modified protein sequence (wt) from DENV-2__KC762678__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRILIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNANRAWNSLEVEDYGFGVFTTNIWLKLKERQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGIGVTYLALLAAFKVRPTFAAGLLLRKLTSKELMMTTIGITLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTSTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRNALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRTAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLSPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVTVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4425 - protein, 3291 aa, Artificial Sequence
  derived and/or modified protein sequence (wt) from DENV-2__KC762679__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSMKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4426 - protein, 3291 aa, Artificial Sequence
  derived and/or modified protein sequence (wt) from DENV-2__KC762680__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDSRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQATIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDFEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSMKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLKGNEEYTDYMPSMKRFRREEGEAGVLW

SEQ ID NO: 4427 - protein, 3291 aa, Artificial Sequence
  derived and/or modified protein sequence (wt) from DENV-2__JQ955624__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFAIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETTECPNTNRAWNSLEVEDYGFGVFTTNIWLKLKERQDVFCDSKLMSAAVKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGILGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQSEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVELMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGFGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVMDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKMGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTTTEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 4428 - protein, 3291 aa, Artificial Sequence
  derived and/or modified protein sequence (wt) from DENV-2__KJ918750__SS-prME
TAGMIIMLIPTVMAFHLTTRNGEPHMIVSRQEKGKSLLFKTKDGTNMCTLMAMDLGELCEDTITYKCPFLRQNEPEDIDCWCNSTSTWVTYGTCTTTGEHRREKRSVALVPHVGMGLETRTETWMSSEGAWKHAQRIEIWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKIMKGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMLETTMRGAKRMAILGDTAWDFGSLGGVFTSIGKALHQVFGAIYGAAFSGVSWTMKILTGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSDGVLESEMVIPKNFAGPVSQHNNRPGYHTQTAGPWHLGKLEMDFDFCEGTTVVVTEDCGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILALVSVSPLFLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWCAQIQPHWIAASIILEFFLIVLLIPEPEKQRTPQDNQLTYVIIAILTVVAATMANEMGFLEKTKKDLGLGNIVTQQPESNILDIDLRPASAWTLYAVATTFITPMLRHSIENSSVNMSLTAIANQATVLMGLGKGWPLSKMDIGVPLLAIGCCSQVNPITLTAALFLLVAHYAIIGPGLQAKATREAQKRAAAGIMKNPTVDGITVIDLDPIPYDPKFEKQLGQVMLLVLCVTQVLIMRTTWALCEALTLATGPVSTLWEGNPGRFWNTTIAVSMANIFRGSYLAGAGLLFCIMNNTTRLRRGTGHLRKTLGDKCKSRLNTLGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKSIQHLTATEEIAVQDWLARVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4429 - protein, 3291 aa, Artificial Sequence
  derived and/or modified protein sequence (wt) from DENV-2__KU517845__SS-prME
TAGIIIMMIPTVIAFHLTTRNGEPHMIVSRQEKGKSLLFKTENGVNMCTLMAMDLGELCEDTITYNCPLLRQNEPEDIDCWCNSTSAWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMAGDIKGIMQAGKRSLRPQPTELKYSWKAWGKAKMLSTELHNHTFLIDGPETAECPNTNRAWNSLEVEDYGFGVFTTNIWLKLKERQDAFCDSKLMSAAIKDNRAIHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLVLTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITVSEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIANQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKIMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTSHMKGEHRKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4430 - protein, 3291 aa, Artificial Sequence
  derived and/or modified protein sequence (wt) from DENV-2__KU517847__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKVLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTENCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTALAVVSVSPLLLTSSQQKTDWIPLALTIKGLNPTAIFLTTLSRTSKKRSWPLNEAIMAVGMVSILASSFLKNDIPMTGPLVAGGLLTVCYVLTGRSADLELERAADIRWEEQAEISGSSPILSITISEDGSMSIKNEEEEQTLTILIRTGLLVISGLFPASIPITAAAWYLWEVKKQRAGVLWDVPSPPPVGRAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIVTASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRRYGGALVRNPPSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTATEEIAVKNWLVRVGRERLSRMAISGDDCVVKPFDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4431 - protein, 3291 aa, Artificial Sequence
  derived and/or modified protein sequence (wt) from DENV-2__JQ955623__SS-prME
TAGMIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIVGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQLESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNDTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVNKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEETAVHDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 4432 - protein, 3291 aa, Artificial Sequence
  derived and/or modified protein sequence (wt) from DENV-2__KR779782__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEQGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4433 - protein, 3291 aa, Artificial Sequence
  derived and/or modified protein sequence (wt) from DENV-2__KM279608__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTVTGEHRREKRSVALVPHVGMGLETRTETWMSSEGAWKHAQRIETWILRHPGFTIMAAILAYTIGTTYLQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDNPVNIEAEPPFGDSYIIIGVEPGQLKLSWYKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWRNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILENAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIKKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4434 - protein, 3291 aa, Artificial Sequence
  derived and/or modified protein sequence (wt) from DENV-2__KM279605__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDNPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILENAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4435 - protein, 3291 aa, Artificial Sequence
  derived and/or modified protein sequence (wt) from DENV-2__KM279609__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4436 - protein, 3291 aa, Artificial Sequence
  derived and/or modified protein sequence (wt) from DENV-2__KM279607__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYLQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDNPVNIEAEPPFGDSYIIIGVEPGQLKLSWYKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILENAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVKLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4437 - protein, 3291 aa, Artificial Sequence
  derived and/or modified protein sequence (wt) from DENV-2__KM279606__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDNPVNIEAEPPFGDSYIIIGVEPGQLKLSWYKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILENAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLAENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4438 - protein, 3291 aa, Artificial Sequence
  derived and/or modified protein sequence (wt) from DENV-2__JN851113__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4439 - protein, 3291 aa, Artificial Sequence
  derived and/or modified protein sequence (wt) from DENV-2__GU370050__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPILRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHKTSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4440 - protein, 3291 aa, Artificial Sequence
  derived and/or modified protein sequence (wt) from DENV-2__JN851129__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLSEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNLWLKLKERQDVFCDSKLMSAAIKDNRAVHADMGYWIESALNDTWKIEKASFIEVKSCHWPKSHTLWSNGVLESEMIIPKSFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDIIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTLVESWEEIPYLGKREDQWCGSLIGLTSRATWAKNIQTAINQVRSLIGNEEYTDYMPSMKRFRREEEEAGVLW

SEQ ID NO: 4441 - protein, 3291 aa, Artificial Sequence
  derived and/or modified protein sequence (wt) from DENV-2__JN851128__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEANHPATLRKYCIEAKLTNTTTASRCPTQGEPSLSEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNLWLKLKERQDVFCDSKLMSAAIKDNRAVHADMGYWIESAINDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDIIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTLVESWEEIPYLGKREDQWCGSLIGLTSRATWAKNIQTAINQVRSLIGNEEYTDYMPSMKRFRREEEEAGVLW

SEQ ID NO: 4442 - protein, 3291 aa, Artificial Sequence
  derived and/or modified protein sequence (wt) from DENV-2__JN851130__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCYWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMALKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4443 - protein, 3291 aa, Artificial Sequence
  derived and/or modified protein sequence (wt) from DENV-2__JN851125__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKMTIMTGDIKGIMQAGKRSLRPQPTELKYSWKAWGKAKMLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKVVRNMEKYQLAVTIMAILCVPNAVILQNAWKVSCTTLAVVSVFPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNESDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSSTTQQHESNILDIDLRPASAWTLYAVATTFITPMLRHSIENSSVNVSLTAIANQATVLMGLGKGWPLSKMDIGVPLLAIGCYSQVNPITLTAALLSLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4444 - protein, 3291 aa, Artificial Sequence
  derived and/or modified protein sequence (wt) from DENV-2__JN851123__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEIKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFIERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPIESWEEIPYLGKREDQWCGSLIGLTSRATWAKNIQTAINQVRSLIGNEEYTDYMPSMKRFRREEEEAGVLW

SEQ ID NO: 4445 - protein, 3291 aa, Artificial Sequence
  derived and/or modified protein sequence (wt) from DENV-2__JN851118__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4446 - protein, 3291 aa, Artificial Sequence
  derived and/or modified protein sequence (wt) from DENV-2__JN851124__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVMRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKMTIMTGDIKGIMQAGKRSLRPQPTELKYSWKAWGKAKMLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKVVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNESDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSSTTQQHESNILDIDLRPASAWTLYAVATTFITPMLRHSIENSSVNVSLTAIANQATVLMGLGKGWPLSKMDIGVPLLAIGCYSQVNPITLTAALLSLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKVTYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4447 - protein, 3291 aa, Artificial Sequence
  derived and/or modified protein sequence (wt) from DENV-2__JN851114__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVEKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4448 - protein, 3291 aa, Artificial Sequence
  derived and/or modified protein sequence (wt) from DENV-2__JN851126__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEIKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHTILLVAVSFVTLITGNMSFRDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTALAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCVKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQTYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKHGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4449 - protein, 3291 aa, Artificial Sequence
  derived and/or modified protein sequence (wt) from DENV-2__JN851121__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITNQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4450 - protein, 3291 aa, Artificial Sequence
  derived and/or modified protein sequence (wt) from DENV-2__JN851115__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWLLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQSAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGYEEYTDYMPSMKRFRREEEEAGVLW

SEQ ID NO: 4451 - protein, 3291 aa, Artificial Sequence
  derived and/or modified protein sequence (wt) from DENV-2__JN851127__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLSEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEIKLTIMTGDIKGIMQAGKRSLRPQPIELKYSWKAWGKAKMLSTELHNHTFLIDGPETAECPNTNRAWNSLEVEDYGFGVFTTNIWLKLKERQDVFCDSKLMSAVIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSRQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFIERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKRKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGVHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPIESWEEIPYLGKREDQWCGSLIGLTSRATWAKNIQTAINQVRSLIGNEEYTDYMPSMKRFRREEEEAGVLW

SEQ ID NO: 4452 - protein, 3291 aa, Artificial Sequence
  derived and/or modified protein sequence (wt) from DENV-2__JN851120__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTVGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRIEEEEAGVLW

SEQ ID NO: 4453 - protein, 3291 aa, Artificial Sequence
  derived and/or modified protein sequence (wt) from DENV-2__JN851131__SS-prME
TAGVIIMMIPTVMAFHLTTRNGEPHMIVSRQEKGKSLLFKTENGVNMCTLMAIDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLKEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQEVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPSKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRVEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWITDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIAIQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEKPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVNKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4454 - protein, 3291 aa, Artificial Sequence
  derived and/or modified protein sequence (wt) from DENV-2__JN851122__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVTHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNIGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4455 - protein, 3291 aa, Artificial Sequence
  derived and/or modified protein sequence (wt) from DENV-2__JN851116__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4456 - protein, 3291 aa, Artificial Sequence
  derived and/or modified protein sequence (wt) from DENV-2__GU370051__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILENAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPDIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNDNDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLTPYMPSVIEKMEALQRKYGGALVRNPLSRNSTHEMYWVSNASGNIVSSVNMISRMLINRFTMRHKKATYEPDVDLGSGTRNIGIESETPNLDIIGKRIGKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVENWLMRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4457 - protein, 3291 aa, Artificial Sequence
  derived and/or modified protein sequence (wt) from DENV-2__EU359009__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAIAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPFPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDTEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4458 - protein, 3291 aa, Artificial Sequence
  derived and/or modified protein sequence (wt) from DENV-2__KC131142__SS-prME
TAGIIIMVIPTVMAFHLTTRNGEPHMIVSRQEKGKSLLFKTENGLNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAIAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNLEIEDDIFRKKRLTVMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDTEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVKLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSARGAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGVHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4459 - protein, 3291 aa, Artificial Sequence
  derived and/or modified protein sequence (wt) from DENV-2__AY858035__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVVSGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNTLGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTRRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4460 - protein, 3291 aa, Artificial Sequence
  derived and/or modified protein sequence (wt) from DENV-2__JX567951__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4461 - protein, 3291 aa, Artificial Sequence
  derived and/or modified protein sequence (wt) from DENV-2__JX567950__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSVTISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFSDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALNELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKYLGLGSITTQESESNILDIDLRPASAWTLYAVATTFVTPMLRHSIVNSSVNVTLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLAENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEIPYLGKREDQWCGSLIGLTSRATWAKNIQTAINQVRSLIGNEGYTDYMPSMKRFRREEEEAGVLW

SEQ ID NO: 4462 - protein, 3291 aa, Artificial Sequence
  derived and/or modified protein sequence (wt) from DENV-2__HQ012538__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4463 - protein, 3291 aa, Artificial Sequence
  derived and/or modified protein sequence (wt) from DENV-2__HQ012533__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4464 - protein, 3291 aa, Artificial Sequence
  derived and/or modified protein sequence (wt) from DENV-2__HQ012534__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMLGVPMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4465 - protein, 3291 aa, Artificial Sequence
  derived and/or modified protein sequence (wt) from DENV-2__HQ012535__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGIALLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLAENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4466 - protein, 3291 aa, Artificial Sequence
  derived and/or modified protein sequence (wt) from DENV-2__HQ012536__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRLDKLQLKGMSYSMCTGKFKIVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNGTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVMVMVGVAMTDDIGMGVTYLALLAAFKVRPTFAAGLLLRKLTSKELMMATIGITLLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMGDKTPVESWEEVPYLGKREDQWCGSLIGLTSRATWAKNIQTAINQVRSLIGNEEYTDYMPSMKRFRREEEEAGVLW

SEQ ID NO: 4467 - protein, 3291 aa, Artificial Sequence
  derived and/or modified protein sequence (wt) from DENV-2__HQ012537__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGIALLSQSTIPETILELTDALALGMMVLRIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYKHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLAENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4468 - protein, 3291 aa, Artificial Sequence
  derived and/or modified protein sequence (wt) from DENV-2__KU365901__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITQELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKEKQDVFCDSKLMSAAIKDNRAVHADMGYWIESALNDTWKIEKASFIEVKSCNWPKSHTLWSNGVLESEMIIPKNFAGPVSQHNYRPGYHTQTAGPWHLGRLEMDFEFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVTFVTLITGNMSFRDLGRVMVMVGATMTDDIGMGVTYLALLAAFKVRPTFAAGLLLRKLTSKELMMATIGIVLLSQSTIPETILELTDALALGMMVLKIVRNMEKYQLAVTIMAILCVPNAVILQNAWRVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGRKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4469 - protein, 3291 aa, Artificial Sequence
  derived and/or modified protein sequence (wt) from DENV-2__GQ398258__SS-prME
TAGMIIMLIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDPKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYKGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVKNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATHQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWVQENPWMEDKTPVESWEEIPYLGKREDQWCGSLIGLTSRATWAKNIQTAINQVRSLIGNEEYTDYMPSMKRFRREEEEAGVLW

SEQ ID NO: 4470 - protein, 3291 aa, Artificial Sequence
  derived and/or modified protein sequence (wt) from DENV-2__GQ398259__SS-prME
TAGMIIMLIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYKGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVKNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATHQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWVQENPWMEDKTPVESWEEIPYLGKREDQWCGSLIGLTSRATWAKNIQTAINQVRSLIGNEEYTDYMPSMKRFRREEEEAGVLW

SEQ ID NO: 4471 - protein, 3291 aa, Artificial Sequence
  derived and/or modified protein sequence (wt) from DENV-2__GQ398268__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4472 - protein, 3291 aa, Artificial Sequence
  derived and/or modified protein sequence (wt) from DENV-2__GQ398263__SS-prME
TAGMIIMMIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPTTNRAWNSLEVEDYGFGVFTTNIWLKLKERQDVLCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKDKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDVIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIYTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4473 - protein, 3291 aa, Artificial Sequence
  derived and/or modified protein sequence (wt) from DENV-2__GQ398264__SS-prME
TAGMIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWMIEKASFIEVKSCHWPKSHTLWSNGVLESEMIIPKNFAGPVSQHNYRPGYHTQTAGPWQLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSTATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4474 - protein, 3291 aa, Artificial Sequence
  derived and/or modified protein sequence (wt) from DENV-2__GQ398260__SS-prME
TAGMIIMLIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELIGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFNFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEIGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4475 - protein, 3291 aa, Artificial Sequence
  derived and/or modified protein sequence (wt) from DENV-2__GQ398262__SS-prME
TAGMIIMLIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVRLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFNFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4476 - protein, 3291 aa, Artificial Sequence
  derived and/or modified protein sequence (wt) from DENV-2__GQ398261__SS-prME
TAGMIIMLIPTVMAFHLTTRNGEPHMIVSRQEKGKSLLFKTEDGVNMCTLMAMDLGELCEDTITYNCPLLRQNEPEDIDCWCNSTSTWITYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFNFCEGTTVVVTGDCGNRGPALRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEIGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4477 - protein, 3291 aa, Artificial Sequence
  derived and/or modified protein sequence (wt) from DENV-2__GQ398313__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4478 - protein, 3291 aa, Artificial Sequence
  derived and/or modified protein sequence (wt) from DENV-2__GQ398285__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRMGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGTIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGGIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNLAGPVSQHNYRPGYHTQTAGPWHLGKLEMDFDFCEGTTVVVTEDCGNRGPSLRTTTASGKLVTEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFARKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4479 - protein, 3291 aa, Artificial Sequence
  derived and/or modified protein sequence (wt) from DENV-2__GQ398298__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGLLGMALFLEEMLRTRVGTKHAMLLVVVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADIKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4480 - protein, 3291 aa, Artificial Sequence
  derived and/or modified protein sequence (wt) from DENV-2__GQ398301__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAASFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4481 - protein, 3291 aa, Artificial Sequence
  derived and/or modified protein sequence (wt) from DENV-2__GQ398312__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLIAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4482 - protein, 3291 aa, Artificial Sequence
  derived and/or modified protein sequence (wt) from DENV-2__GQ398289__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLIAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSLFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRRNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4483 - protein, 3291 aa, Artificial Sequence
  derived and/or modified protein sequence (wt) from DENV-2__GQ398290__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENFEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTENCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNTLGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4484 - protein, 3291 aa, Artificial Sequence
  derived and/or modified protein sequence (wt) from DENV-2__GQ398284__SS-prME
TAGVIIMLIPTAMAFHLTTRNGEPHMIVGKQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVALGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYRAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHANHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4485 - protein, 3291 aa, Artificial Sequence
  derived and/or modified protein sequence (wt) from DENV-2__GQ398308__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNDTQFCIKVLNPYMPSVIEKMETLQRKYGGAIVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4486 - protein, 3291 aa, Artificial Sequence
  derived and/or modified protein sequence (wt) from DENV-2__GQ398287__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNLAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLIAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSLFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTVLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRRNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4487 - protein, 3291 aa, Artificial Sequence
  derived and/or modified protein sequence (wt) from DENV-2__GQ398302__SS-prME
TAGVIIMLIPTAMAFHLTTRNGEPHMIVSRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4488 - protein, 3291 aa, Artificial Sequence
  derived and/or modified protein sequence (wt) from DENV-2__GQ398272__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIITQESESNILDIDLRPASAWTLYAVATTFVTPMLRHSIENSSVNVSLTAIANQATVLMGLGRGWPLSKMDIGVPLLAIGCYSQVNPITLIAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 4489 - protein, 3291 aa, Artificial Sequence
  derived and/or modified protein sequence (wt) from DENV-2__GQ398292__SS-prME
TAGVFIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWIMRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKSKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAMLLVAVSFVTLITGNMSFRDLGRVMVMVGATMTDDIGMGITYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELIDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4490 - protein, 3291 aa, Artificial Sequence
  derived and/or modified protein sequence (wt) from DENV-2__GQ398267__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLIAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNIGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALIALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4491 - protein, 3291 aa, Artificial Sequence
  derived and/or modified protein sequence (wt) from DENV-2__GQ398266__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLIAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4492 - protein, 3291 aa, Artificial Sequence
  derived and/or modified protein sequence (wt) from DENV-2__GQ398265__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4493 - protein, 3291 aa, Artificial Sequence
  derived and/or modified protein sequence (wt) from DENV-2__KX702403__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALILILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCEKRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPHDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEETAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4494 - protein, 3291 aa, Artificial Sequence
  derived and/or modified protein sequence (wt) from DENV-2__KX702404__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEIKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTNENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4495 - protein, 3290 aa, Artificial Sequence
  derived and/or modified protein sequence (wt) from DENV-2__JQ686088__SS-prME
TTGMIIMLIPTVMAFHLTTRNGEPHMIVSRQDKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGIANRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMKGKIVQPENLEYTIVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDRPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGNGIFVTDNVHTWTEQYKFQPESPSKLASAIQKAHEEGICGIRSVTRLENLMWKQITPELNHILSENEVKLTIMTGDIKGIMQVGKRSLQPQPTELRYSWKTWGKAKMLSTELHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNLAGPVSQHNNRPGYYTQTAGPWHLGKLEMDFDFCKGTTVVVTEDCGNRGPSLRTTTASGKLITEWCCRSCTLPPLRYRGEDGCWYGMEIRPLKEKEENLVNSLVTAGHGQIDNFSLGILGMALFLEEMLRTRVGTKHAILLVAVSFVTLITGNMSFRDLGRVIVMVGATMTDDIGMGVTYLALLAAFKVRPTFAAGLLLRKLTSKELMMTTIGIVLLSQSSIPETILELTDALALGMMILKMVRNMEKYQLAVTIMAILCVPNAVILQNAWKVSCTILAVVSVSPLLLTSSQQKADWIPIALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVVSGLFPVSVPITAAAWYLWEVKKQRAGVLWDVPSPPPAGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPVRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYIKTRTNDWDFVVTTDISEMGANFKAQRVIDPRRCMKPVILTDGEERVILAGPMPVTHSSAAQRGRVGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYADPLALKEFKEFAAGRKSLTLNLITEMGRLPTFMTQKVRDALDNLAVLHTAEAGGKAYNHALNELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIVTQQPESNILDIDLRPASAWTLYAVATTFITPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSARRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFIPPERCDTLLCDIGESSPSPTVEAGRTLRVLNLVENWLSNNTQFCVKVLNPYMPSVIEKMEALQRKHGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTKKVRSNAALGAIFTDENKWKSAREAVGDGRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMEGEHKKLAEAIFRLTYQNKVVRVQRPTPRGTVMDIISRRDQRGSGQVGTYGLNTFTNMEAQLIRQMEGEGVFKSIQHLTAAEEIAVQNWLVRVGRERLSRMAISGDDCVVKPLDDRFARALTALNDMGKVRKDIQQWEPSRGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHASHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4496 - protein, 3291 aa, Artificial Sequence
  derived and/or modified protein sequence (wt) from DENV-2__KF479233__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPQNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYKGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVELMRRGDLPVWLAYRVAAEGINYADRRWCFDGIKNNQILEENVEVEIWTKEGEKKKLKPRWLDARIYSDPLALKEFKEFAAGRKSLTMNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIVTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNSLGKSEFQIYKRSGIQEVDRTLAKEGIKRGETDHHAVSRGSAKLRWFVERNLVTPEGKVMDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTTTEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 4497 - protein, 3291 aa, Artificial Sequence
  derived and/or modified protein sequence (wt) from DENV-2__KX372564__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKVLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTALAVVSVSPLLLTSSQQKTDWIPLALTIKGLNPTAIFLTTLSRTSKKRSWPLNEAIMAVGMVSILASSFLKNDIPMTGPLVAGGLLTVCYVLTGRSADLELERAADIRWEEQAEISGSSPILSITISEDGSMSIKNEEEEQTLTILIRTGLLVISGLFPVSIPITAAAWYLWEVKKQRAGVLWDVPSPPPVGRAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIVTASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRRYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTATEEIAVKNWLVRVGRERLSRMAISGDDCVVKPFDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4498 - protein, 3290 aa, Artificial Sequence
  derived and/or modified protein sequence (wt) from DENV-2__KX274130__SS-prME
SAATLLLLVPTIMAFHLTTRNGEPHMIVARHEKGKSLIFKTENGVNMCTLMAMDLGELCEETVTYKCPYLKQSEPEDIDCWCNTTSTWVTYGTCSSSGEHRREKRSVALAPHVGMGLETRTETWMSSEGAWKHAQRIENWILRHPGYTVMAAAIAMAIGTNNFQRALIFVLLTAVAPSMTMRCVGIANRDFVEGVSGGSWVDIVLEHGSCVTTMAKNKPTLDFELTKTEAKLPATLRKYCIEAKLTNTTTESRCPTQGEPSLPEEQDKRFICRHSLVDRGWGNGCGLFGKGGIVTCAMFTCKKYMEGKIVQPENLEYTVAVTPHSGEEHSVGNDTGKHGQDVKITPQSSITETALEGYGSISMECSPRTGLDFNEMVLLQMEDKAWLVHRQWFLDLPLPWLPGSDTQGSNWVQKETLVTFKNPHAKKQDVVVLGSQEGAMHSALTGATEIQMTSGNLLFTGHLKCRLRMDKLELKGMSYSMCTGKFKVVKEIAETQHGTIVIRVQYEGEGSPCKIPFEIMDLEKKHVLGRLITVNPIITEKDKPTNIEAEPPFGDSYILIGVEPGQLKMNWFKKGSSIGQMFETTMRGAKRMAILGDTAWDFGSLGGVFNSIGKALHQVFGAVYNAAFSGVSWTMKILIGVIITWIGMNSRSTSMSITLVMVGLVTLYLGVVVQADSGCVVSWKTKELKCGSGIFVTDNVHVWTEQYKFQPESPAKLAAAIKKAHEEGVCGIRSVTRLENIMWKQITPELNHILTENDVKVTIMTGDIKGILQQGRRALRPQPTELKYSWKSWGKSKIVSSETHNQTFLIDGPETTECPDTNRAWNSLEVEDYGFGLFSTNIWLRLREKQDTLCDSKLMSAAVKDERAIHADMGYWIESKLNGSWKIEKASFLEVKSCTWPRSHTLWSNGVLESEMIIPKNLGGPVSQHNYRPGYYTQTTGPWHLGKLEMDFDYCEGTTVIVTEECNNRGPSLRTTTASGKLITEWCCRSCTMPPLRFKGEDGCWYGMEIRPLKEKEENLVNSLVTAGHGQIDNFSLGILGIALFLEEVMKSRIGIKHTIGMTIITFLLLVTGNVSYRDLGRVILMVGSTMADEMGMGVTYLALLATFRIRPTFALALMIRKLTSKELLMATIGIVLIAQCDVPGTILEITDACALGLMLLKMTRELERYQLAVTLLSLTCIPNATIMWGAWKVTCTILTLVSMAPLFLTTSRQKTDWVPVALSIYGLNPTAIYFTTLAKAKKIRSWPLNEAVMAVGMVSILASSLLRNDIPMAGPLVAGGLLTLCYVLTGRSADLELEKSADIKWNDDAEISGSSPIINVAVSEDGSMSIKDEEEENTLTILIRTGLLAISGMYPMAIPATAAVWYFWEARKQRAGVLWDVPSPPPTGKAELEEGAYRIKQRGIFGYSQIGAGVYKEGTFHTMWHVTRGSVLMCKGKRLEPSWADVKKDLISYGGGWRLDGEWTEGEEVQVLALEPGKNPRAVQTKPGMFKTDTGRIGAVSLDFAPGTSGSPIIDKKGKVIGLYGNGVVMKSGAYVSSIAQTEKREDEIPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYIATRVEMGEAAGIFMTATPPGSKDPFPQSNAPIMDEEREIPERSWNSGHEWITDFEGKTVWFVPSIRAGNDIATCLRKNGKKVIQLSRKTFDTEYIKTRNNDWDFVVTTDISEMGANFKAERVIDPRRCMKPVILTDGEERVILAGPMPVTPSSAAQRRGRIGRNPKNENDQYIYMGEPLENDEDCAHWKEAKMLLDNINTPEGIIPAMFGPEREKTDAIDGEYRLRGESRKTFVELMRRGDLPVWLAYKVASEGYSYADRRWCFEGVKNNQILEENLEVEIWTKEGERKKLRPKWLDARTYSDPQALKDFKEFAAGRKSTTLNLIAELGRLPTYMTQKTRDALDNLAVLHTAEEGGRAYQHAISELPETLETLLLLCLLATVSGGVFLFLMSGKGIGKMSMGLGCIITASGLLWYAQIQPHWIAASIILEFFLIVLLIPEPEKQRTPQDNQLTYVVIAILTLVAATMANEMGYLEKTKKDLGFGNPYVASHEAAILDIDLHPASAWTLYAVATTLITPMLRHSIENSSTNVSLTAIANQATVLMGLGKGWPLSRMDLGVPLLALGCYSQVNPLTLTASLLLLIGHYAIIGPGLQAKATREAQKRTAAGIMKNPTVDGITVIDIEPIPYDPKFEKQLGQVMLLVLCVAQVLMMRTTWAMCEALTIATGPISTLWEGNPGKFWNTTIAVSMANIFRGSYLAGAGLLFSIMKNTVTGRRGTGVAGETLGEKWKIKLNGLGRTDFQTYKRSGIIEVDRTLAKEGIKRGETNHHAVSRGSAKLRWFVERNLVKPEGKVIDLGCGRGGWSYYCGGLKNVTEVKGLTKGGPGHEEPIPMSTYGWNLVRLQSGVDVFFTPPEKCDTLLCDIGESSPNPTIEAGRTLRVLNMVENWLGNNQFCIKVLNPYMPSVIEKMENLQRKFGGTLVRNPLSRNSTHEMYWVSNASGNIVSSVNMISRMLINRFTMKHKKPTYEQDVDLGSGTRNVGIETEKPNLEIIGKRIEKIKDEHKQTWHYDLDHPYKTWAYHGSYETKQTGSASSMINGVVKLLTKPWDVIPMVTQMAMTDTTPFGQQRVFKEKVDTRTPEPKEGTKKLMKLTAKWLWAELGRHKVPRMCTRDEFTNKVRSNAAMGAVFTEENRWSSAKEAVEDEAFWDLVDRERKLHLQGKCETCVYNMMGKREKKLGEFGRAKGSRAIWYMWLGARFLEFEALGFLNEDHWFSRENSLSGVEGEGLHKLGYILREIGAKDGGMMYADDTAGWDTRVTEEDLKNEEMISEQMKGEHRTLAEAIFKLTYQNKVVRVQRPTPKGTVMDIISRRDQRGSGQVGTYGLNTFTNMEAQLIRQMEGEGLFRDISKLTIQEETAILTWLKEKGRDRLSRMAISGDDCVVKPVDDRFAHALTALNDMGKVRKDIQQWEASKGWNDWTQVPFCSHHFHEIIMKDGRKLVVPCRNQDELIGRARISQGAGWALKETACLGKAYAQMWSLMYFHRRDLRLAANAICSAVPSHWVPTSRTTWSIHAHHQWMTTEDMLDVWNRVWILENPWMDDKTCVKSWEEVPYLGKREDQWCGSLIGLTSRATWAKNIKVAIEQVRSLIGKEEYTDYMPSMKRFKQEQSTEGALW

SEQ ID NO: 4499 - protein, 3291 aa, Artificial Sequence
  derived and/or modified protein sequence (wt) from DENV-2__GU289914__SS-prME
SAGMIIMLIPTVMAFHLTTRNGEPHMIVSRQEKGKSLLFKTEDGVNMCTLMAMDLGELCEDTITYNCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVDPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVVVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4500 - protein, 3291 aa, Artificial Sequence
  derived and/or modified protein sequence (wt) from DENV-2__AY858036__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLARTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAETGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSEFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4501 - protein, 3291 aa, Artificial Sequence
  derived and/or modified protein sequence (wt) from DENV-2__HQ332184__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTGWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVAASFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4502 - protein, 3291 aa, Artificial Sequence
  derived and/or modified protein sequence (wt) from DENV-2__HQ332185__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKIKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKNNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4503 - protein, 3291 aa, Artificial Sequence
  derived and/or modified protein sequence (wt) from DENV-2__HQ332186__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTFWSNGVLESEMIIPKNFAGPVSQHNYRPGYHTQIAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHTYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4504 - protein, 3291 aa, Artificial Sequence
  derived and/or modified protein sequence (wt) from DENV-2__HQ332187__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRIQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMILKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPVIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFGELVDKERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4505 - protein, 3291 aa, Artificial Sequence
  derived and/or modified protein sequence (wt) from DENV-2__HQ332188__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGVMQAGKRSLRPQPTELKYSWKTWGKAKMLSTESHNQTFLIDGPETTECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQIAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGATYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEIQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4506 - protein, 3291 aa, Artificial Sequence
  derived and/or modified protein sequence (wt) from DENV-2__HQ332189__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIENWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPSPTIEAGRTLRVLNLVEDWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHTYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4507 - protein, 3291 aa, Artificial Sequence
  derived and/or modified protein sequence (wt) from DENV-2__JN368476__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMESKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASVLLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 4508 - protein, 3291 aa, Artificial Sequence
  derived and/or modified protein sequence (wt) from DENV-2__JF260983__SS-prME
TAGFLIMVIPTVMAFHLTTRNGEPHMIVSKNEKGKGLLFKTENGINMCTLMAMDLGELCEDTVTYKCPFLKQNEPEDIDCWCNSTSTWVTYGTCSSTGEHRREKRSVALVPHVGMGLETRTETWMSSEGAWKQAQRIETWILRHPGFTLMAAVLAYTIGTTHFQRALIFILLTAVAPSMTMRCIGISNRDFVEGVSGGSWVDIVLEHGSCVTTMAKNKPTLDFELIKTEAKQPATLRKFCIEAKLTNTTTESRCPTQGEPSLVEEQDKRFVCRHSMVDRGWGNGCGLFGKGGIVTCAMFTCLKKMEGKVVQPENLEYTIVITPHSGEEHAVGNDTGKHGKEVKITPQSSISETELTDYGTITMECSPRTGLDFNEMVLLQMESKAWLVHRQWFLDLPLPWLPGADTQGSNWIQKEMLVTFKNPHAKRQDVVVLGSQEGAMHTALTGATEIQMSLGNILFMGHLKCRLRMDKLQLKGMSYSMCTGKFKVVKEIAETQHGTIVIRVQYEGDDSPCKIPFEIMDLEKKHVLGRLITVNPIVTEKDSPINIEAEPPFGDSYIVIGVEPGQLKLNWFKKGSSIGQMFETTMRGAKRMAILGDTAWDFGSIGGVFTSVGKALHQVFGAIYGAAFSGVSWTMKILIGVVITWIGMNSRSTSLSVTLVLVGIVTLYLGVMVQADSGCVVSWKNKELKCGSGIFVTDNVHTWTEQYKFQPDSPSKLASAIQKAHEEGICGIRSVTRLENLMWKQITPELNHILSENEVKLTIMTGEIKGIMQAGRRSLKPQPTELRYSWKTWGKAKVLSTELQNQTFLIDGPETTECPNSNRAWNSLEVEDYGFGIFTTNIWLKLREKQDMICDSKLMSAAVKDDRAVHADMGYWIESRLNDTWKMEKASFIEVKSCYWPRSHTLWSNGVLESEMIIPKNLAGPVSQHNYRPGYYTQTAGPWHLGKLEMDFEFCEGTTVVVTEDCGNRGPSLRTTTASGKLITEWCCRSCTLPPLRYRGEDGCWYGMEIRPLKEREENLVNSLVTAGHGQIDNFSLGILGMALLLEEMLRTRVGTKHALLLVAISFVTLITGNMSFKDLGRVIIMVGAAMTDEMGMGVTYLALLAAFRVRPTFAVGLLLRKLTSKELLMATIGVVLLSQSNIPGTVLELTDAIALGIMVLKIMRSMEKYQLAVTVMAMLCIPNVMILQHAWKVGCTILAAVSVSPLLLTSSQQKTDWIPLALTIKGLNPTAIFLTTLSRPSKIRSWPLNEAIMAVGMVSILASSLLKNDIPMTGPLVAGGLLTVCYVLTGRSADLELEKAAEVKWEDQAEISGSSPILSITISEDGSMSIKNEEEEQTLTILIRTGLLVISGLFPVSIPITAAAWYLWETKKQRAGVLWDVPSPPPMGKAELEDGAYRIKQRGIFGYSQIGAGVYKEGTFHTMWHVTRGAVLVHKGKRLEPSWADVKKDLISYGGGWKLEGEWKDGEEVQVLALEPGKNPRAVQTKPGLFKTNTGTIGAVSLDFSPGTSGSPIIDRKGKVVGLYGNGVVTRSGTYVSSIAQTEKSVEDNPEIEDDIFRKKRLTIMDLHPGAGKTKRYLPAIVREAIRRGLRTLILAPTRVVAAEMEEALRGLPIRYQTPAIKAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWITNFKGKTVWFVPSIRAGNDIAACLRKNGKRVIQLSRKTFDTEYTKTRTNDWDFVVTTDISEMGANFKAERVIDPRRCMKPVILTDGEERVVLAGPMPVTHSSAAQRRGRIGRNPKNENDQYIYMGEPLENDEDCAHWKEAKMLLDNINTPEGIIPSMFEPEREKVDAIDGEYRLRGEARKTFVDLMKRGDLPVWLAYKVASEGINYADRKWCFDGIRNNQILEENIEVEVWTKEGERKKLKPRWLDARTYSDPLALKEFKEFAAGRKSLTLSLITEMGRLPTFMTQKTRDALDNLAVLHSAEMGGRAYNHALSELPETLETLLLLGLLATVTGGIFLFLMSGRGVGKMTLGMCCIITASGLLWYAQIQPHWIAASIILEFFLIVLLIPEPEKQRTPQDNQLTYVVIAILTLVAATMANEMGFLEKTKKDLGLGGFTMQQPEINILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLVLCVTQVLMMRTTWALCEALTLATGPISTLWEGNPGKFWNTTIAVSMANIFRGSYLAGAGLLFSIMRNTTSARRGTGTIGETLGEKWKSRLNALGRSEFQIYKKSGIQEVDRTLAKEGIKRGETDHHAVSRGSAKLRWFVERNMVAPEGKVVDLGCGRGGWSYYCGGLKNVREVKGLTKGGPGHEEPIPMSTYGWNLVRLQSGVDVFFTPPERCDTLLCDIGESSPNPTVEAGRTLRVLNLVENWLGSNTQFCIKVLNPYMPSVIERMETLQRKFGGALVRNPLSRNSTHEMYWVSNASGNIVSSVNMISRMLINRFTMRHKKATYEPDVDLGSGTRNIGIECETPNMDIIGKRIEKIKQEHEASWHYDQDHPYKTWAYHGSYETKQTGSASSMVNGVVRLLTKPWDVIPMVTQMAMTDTTPFGQQRVFKEKVDTRTQEPKEGTKKLMRITAEWLWGELGRRKKPRICTRAEFCNKVRSNAALGAVFTDENKWKSAREAVEDERFWELVEKERNLHLDGKCETCVYNMMGKREKKLGEFGKAKGSRAIWYMWLGARFLEFEALGFLNEDHWFSRENSLSGVEGEGLHKLGYILRDISRKAGGAMYADDTAGWDTRITSEDLKNEEMITDQMEGRHKKLAEAIFRLTYQNKVVRVQRPTPRGTVMDIISRRDQRGSGQVGTYGLNTFTNMEAQLIRQMEGEGLFKSILHLTPQEETAVHAWLVREGRERLARMAISGDDCVVKPLDDRFARALTALNDMGKVRKDIQQWEPSKGWSDWTQVPFCSHHFHELIMKDGRKLVVPCRNQDELIGRARISQGAGWSLRETACLGKSYAQMWSLMYFHRRDLRLAANAICSAVPSHWVPTSRTTWSIHASHEWMTTEDMLAVWNRVWIQDNPWMEDKTPVESWEDIPYLGKREDQWCGSLIGLTSRATWAKNIQTAINQVRALIGEEEYMDYMPSMKRFRSEEEESGVLW

SEQ ID NO: 4509 - protein, 3291 aa, Artificial Sequence
  derived and/or modified protein sequence (wt) from DENV-2__AF119661__SS-prME
TVGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFIIMAAILAYTIGTTHFQRALIFILLTAVAPSMTMRCIGVSNRDFVEGVSGGSWVDIVLEHGSCVTTMAKNKPTLDFELIKTEAKQPVTLRKYCIKAKLTNTTTESRCPTQGEPSLNEEQDKRFVCKHSMVDRGWGNGCGLFGKGGIVTCATFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWVKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEESLVDSLVTAGHGQIDNFSLGVLGMALFLEEMLRTRVGTKHAILLVAVSFVTLITGNMSLRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLARTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVEKAELEDGAYRIKQKGILGYSQIGTGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPANIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLMVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFFIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKAVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4510 - protein, 3291 aa, Artificial Sequence
  derived and/or modified protein sequence (wt) from DENV-2__EU056810__SS-prME
TAGIIIMLIPTVMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTELHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEVDFNFCEGTTVVVTGDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEITVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4511 - protein, 3291 aa, Artificial Sequence
  derived and/or modified protein sequence (wt) from DENV-2__EU056811__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMVIPKNIAGPVSQHNNRPGYHTQTAGPWHLGKLEMDFDFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFLTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTTLAVVSVSPLLLTSSQQKADWIPLALTIKGLNPTAIFLTTLTRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPPVGRAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRGGAYVSAIAQTEKGIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGHIATQQPESNILDIDLRPASAWTLYAVATTFITPMLRHSIENSSVNVSLTAIANQATVLMGLGKGWPLSKMDIGVPLLAIGCYSQVNPITLTAALLMLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNMGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTKKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVVTYGLNTFTNMEAQLIRQMEGEGVFKSIQHLTASEEIAVQDWLVRVGRERLSRMAISGDDCVVKPLDDRFAKALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 4512 - protein, 3291 aa, Artificial Sequence
  derived and/or modified protein sequence (wt) from DENV-2__DQ645545__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSQGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4513 - protein, 3291 aa, Artificial Sequence
  derived and/or modified protein sequence (wt) from DENV-2__DQ645546__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4514 - protein, 3291 aa, Artificial Sequence
  derived and/or modified protein sequence (wt) from DENV-2__DQ645547__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKYAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4515 - protein, 3291 aa, Artificial Sequence
  derived and/or modified protein sequence (wt) from DENV-2__DQ645549__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKVKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4516 - protein, 3291 aa, Artificial Sequence
  derived and/or modified protein sequence (wt) from DENV-2__DQ645550__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRLWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKVKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4517 - protein, 3291 aa, Artificial Sequence
  derived and/or modified protein sequence (wt) from DENV-2__DQ645551__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYTDRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4518 - protein, 3291 aa, Artificial Sequence
  derived and/or modified protein sequence (wt) from DENV-2__DQ645552__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTSRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4519 - protein, 3291 aa, Artificial Sequence
  derived and/or modified protein sequence (wt) from DENV-2__DQ645553__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSPGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLAVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4520 - protein, 3291 aa, Artificial Sequence
  derived and/or modified protein sequence (wt) from DENV-2__DQ645554__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4521 - protein, 3291 aa, Artificial Sequence
  derived and/or modified protein sequence (wt) from DENV-2__DQ645555__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSQGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4522 - protein, 3291 aa, Artificial Sequence
  derived and/or modified protein sequence (wt) from DENV-2__DQ645556__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKNIQQLTATEEIAVKNWLARVGRERLSRMAISGDDCVVKPLDDRFASALTALNDMGKVRKDVQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4523 - protein, 3291 aa, Artificial Sequence
  derived and/or modified protein sequence (wt) from DENV-2__AF204178__SS-prME
TAGMIIMLIPTVMAFHLTTRNGEPHMIVSRQEKGKSLLFKTGDGVNMCTLMAMDPGELCEDTITYKCPLLKQNEPEDIDWWCNSTSTWVTYGTCTTTGEHRREKRSVALVPHVGMGLETRTETWMSSEGAWKHAQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTFAMFTCKKNMKGKVVQPENLEYTIVITPHSGEEHAVGNDTGKHGKEIKITPQSSITEAELTGYGTVTMKCSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDDVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAVIKDNRAAHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFITSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDAKIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKIRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVGNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLYKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVRRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4524 - protein, 3291 aa, Artificial Sequence
  derived and/or modified protein sequence (wt) from DENV-2__AF204177__SS-prME
TAGMIIMLIPTVMAFHLTTRNGEPHMIVSRQEKGKSLLFKTGDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDLELIKTEAKQSATLRKYCIEAKLTNTTTESRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNEVLESEMIIPKNFAGPVSQHNYRPGYHTQTAGPWHLGKLEMDFDFCEGTTVVVTEDCGNRGPSLRTTTASGKLITECCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSKTNKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYAGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKRGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETLWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKRKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQNELIGRARISQGAGWSLRETACLGKSYAQMWSLMYFHRRDLRLAANAICSAVPSHWVPTSRTTWSIHAKHEWMTTEDMLTVWNRVWIQENPWMEDKTSVESWEEIPYLGKREDQWCGSLIGLTSRATWAKNIQTAINQVRSLIGNEEYTDYMPSMKRFRREEEEAGVLW

SEQ ID NO: 4525 - protein, 3291 aa, Artificial Sequence
  derived and/or modified protein sequence (wt) from DENV-2__DQ645540__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELTKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKVKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4526 - protein, 3291 aa, Artificial Sequence
  derived and/or modified protein sequence (wt) from DENV-2__DQ645541__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELTKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4527 - protein, 3291 aa, Artificial Sequence
  derived and/or modified protein sequence (wt) from DENV-2__DQ645542__SS-prME
TAGVIIMMIPTVVAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELTKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGGIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVMDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWIEDKTPVESWEEIPYLGKREDQWCGSLIGLTSRATWAKNIQTAINQVRSLIGNEEYTDYMPSMKRFRREEEEAGVLW

SEQ ID NO: 4528 - protein, 3291 aa, Artificial Sequence
  derived and/or modified protein sequence (wt) from DENV-2__AY702036__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAINRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASSLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4529 - protein, 3291 aa, Artificial Sequence
  derived and/or modified protein sequence (wt) from DENV-2__AY702034__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAINRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASSLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4530 - protein, 3291 aa, Artificial Sequence
  derived and/or modified protein sequence (wt) from DENV-2__AF208496__SS-prME
TAGVIVMLIPTAMAFHLTTRNGEPHMIVGRQEKGKSLLFKTEDGVNMCTLMAIDLGELCEDTITYKCPFLRQNEPEDIDCWCNFTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASSLLWYAQIQPHWIAASIILEFFLIVLLIPEPEKQRTPQDNQLTYVVIAILTVVAATMANEMGFLEKTKKDLGLGSIATQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHKRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4531 - protein, 3291 aa, Artificial Sequence
  derived and/or modified protein sequence (wt) from DENV-2__AY702040__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDAFCDPKLMSAAIKDNRAVHADMGYWIESALNDTWKIEKASFIEVKSCHWPKSHTLWSNGVLESEMVIPKNFAGPVSQHNNRPGYHTQTAGPWHLGKLEMDFDFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSIIISEDGSMSIKNEEEEQTLTILIRTGLLVISGLFPVSIPITAAAWYLWEVKKQRAGVLWDVPSPPPVGRAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRGGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDFGLGHIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSARRGTGNMGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTKKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRKDQRGSGQVGTYGLNTFTNMEAQLIRQMEGEGIFKSIQHLTASEEIAVQDWLVRVGRERLSRMAISGDDCVVKPLDDRFAKALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 4532 - protein, 3291 aa, Artificial Sequence
  derived and/or modified protein sequence (wt) from DENV-2__AY037116__SS-prME
TAGIIIMMIPTVMAFHLTTRNGEPHMIVSRQEKGKSLLFKTENGVNMCTLMAMDLGELCEDTITYNCPLLRQNEPEDIDCGCHSTSTWVTYGTCTATGEHRREKRSVALVPHVGMGLETRTETWMSSEGAWKHAQRIETWVLRHPGFTIMAAILAYTIGTTYFQRVLIFILLTAVTPSMTMRCIGISNRDFVEGVSGGSWVDIVLEHGSCVTTMAKNKPTLDFELVKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDAWALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPASIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDIIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4533 - protein, 3291 aa, Artificial Sequence
  derived and/or modified protein sequence (wt) from DENV-2__AF169678__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIQNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4534 - protein, 3291 aa, Artificial Sequence
  derived and/or modified protein sequence (wt) from DENV-2__AF169679__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPKTAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4535 - protein, 3291 aa, Artificial Sequence
  derived and/or modified protein sequence (wt) from DENV-2__AF169680__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCIIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQNFLIDGPETAECPNTNRAWNSLEVEDYGFGVFTTNVWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWERQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRKMTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPSVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHTVSRGSAKLRWFVERNMITPEGKVLDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4536 - protein, 3291 aa, Artificial Sequence
  derived and/or modified protein sequence (wt) from DENV-2__AF169682__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPSLSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNCLARLGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4537 - protein, 3291 aa, Artificial Sequence
  derived and/or modified protein sequence (wt) from DENV-2__AF169681__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPKTAECPNTNRAWNSLEVEDYGFGVFTTNIWLKLKEKQDALCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWENQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLRYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4538 - protein, 3291 aa, Artificial Sequence
  derived and/or modified protein sequence (wt) from DENV-2__AF169683__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMHAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSESQIYKKSGIQEVDRTLAKEGIKRGETDHHAVSRGSAKLRWFVERNMVTPEGKVVDLGCGRGGWSYYCGGIKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGLEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4539 - protein, 3291 aa, Artificial Sequence
  derived and/or modified protein sequence (wt) from DENV-2__AF169684__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISRSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKKYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIFLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRRYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4540 - protein, 3291 aa, Artificial Sequence
  derived and/or modified protein sequence (wt) from DENV-2__AF169685__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRRYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4541 - protein, 3291 aa, Artificial Sequence
  derived and/or modified protein sequence (wt) from DENV-2__AF169686__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKIFIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPVNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKKYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRRYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFETLGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLAVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4542 - protein, 3291 aa, Artificial Sequence
  derived and/or modified protein sequence (wt) from DENV-2__AF169687__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILSENEVKLTIMTGDIKGIMHAGKRSLRPQPTELKYSWKTWGIAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVTVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGSGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGSHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4543 - protein, 3291 aa, Artificial Sequence
  derived and/or modified protein sequence (wt) from DENV-2__AF169688__SS-prME
SAGMIIMLIPTVMAFHLTTRNGEPHMIVSIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQTSSGNLLFTGHLKCRLRMDKLQLKGMSYSMCTGKFKVVKEIAETQHGTIVIRVQYEGDGSPCRIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMHAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLILTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHFSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLALNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILVFFLIVLLIPEPEKQRTPQDNQLTYVVIAILTVVAATMANEMGFLEKTKKDLGFGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGKTLGEKWKSRLNALGKIEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 4544 - protein, 3290 aa, Artificial Sequence
  derived and/or modified protein sequence (wt) from DENV-3__AB189125__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPSWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENVDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGVMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRSQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4545 - protein, 3290 aa, Artificial Sequence
  derived and/or modified protein sequence (wt) from DENV-3__AB189126__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKVVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGILFIFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVPPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEELEGAIW

SEQ ID NO: 4546 - protein, 3290 aa, Artificial Sequence
  derived and/or modified protein sequence (wt) from DENV-3__AB189127__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKVVTAEIQNSSFIIDGPNTPECPNASRAWNVWEVEDYGFGVFTTNIWLKLREMYTQLCDHRLMSAAVKDERAIHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGILFMFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPSWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVPPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEELEGAIW

SEQ ID NO: 4547 - protein, 3290 aa, Artificial Sequence
  derived and/or modified protein sequence (wt) from DENV-3__AB189128__SS-prME
TSLCLMMILPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTVLALFLAHFIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPTELKYSWKTWGKAKIVTAETQNSSFIIDGPNTPECPSASRAWNVWEVEEYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAANVTWEEEAEQTGVSHNLMITVDDDGTMRIKDDETENILTVLLKTALLIVSGIFPYSIPATLLVWHTWQKQTQRSGVLWDVPSPPETQKAELEDGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPISYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLILCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLEAEGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGHTSRATWAQNILTAIQQVRSLIGNEEFLDYMPSMKRFRKEEESEGAIW

SEQ ID NO: 4548 - protein, 3290 aa, Artificial Sequence
  derived and/or modified protein sequence (wt) from DENV-3__AB214879__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSVFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALTSLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKSGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIAFDLVTEIGRVPSHLAHRTRNALDNLVMLHTSEHGGRAYRHAVEELPETMETLLLLGLMILLTGGAMLFLISGKGIGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKRITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4549 - protein, 3290 aa, Artificial Sequence
  derived and/or modified protein sequence (wt) from DENV-3__AB214880__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALASLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKSGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIAFDLVTEIGRVPSHLAHRTRNALDNLVMLHTSEHGGRAYRHAVEELPETMETLLLLGLMILLTGGAMLFLISGKGIGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKRITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4550 - protein, 3290 aa, Artificial Sequence
  derived and/or modified protein sequence (wt) from DENV-3__AB214881__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALASLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKSGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIAFDLVTEIGRVPSHLAHRTRNALDNLVMLHTSEHGGRAYRHAVEELPETMETLLLLGLMILLTGGAMLFLISGKGIGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKRITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEELEGAIW

SEQ ID NO: 4551 - protein, 3290 aa, Artificial Sequence
  derived and/or modified protein sequence (wt) from DENV-3__AB214882__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGILEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALASLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKSGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIAFDLVTEIGRVPSHLAHRTRNALDNLVMLHTSEHGGRAYRHAVEELPETMETLLLLGLMILLTGGAMLFLISGKGIGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKRITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4552 - protein, 3290 aa, Artificial Sequence
  derived and/or modified protein sequence (wt) from DENV-3__JX669489__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQIANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4553 - protein, 3290 aa, Artificial Sequence
  derived and/or modified protein sequence (wt) from DENV-3__JX669498__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFGNALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4554 - protein, 3290 aa, Artificial Sequence
  derived and/or modified protein sequence (wt) from DENV-3__KF954946__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLAILRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSMLASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKDGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTMAAIIAANEMGLLETTKRDLGMSKEPGVVSPTSYLDVDLHPASAWTLYAVATTVITPMLRHTIENSTANVSLAAIANQAVVLLGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKTDLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAIPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4555 - protein, 3290 aa, Artificial Sequence
  derived and/or modified protein sequence (wt) from DENV-3__KF954947__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSMLASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKDGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTMAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQRMDPEHRLLANAIFKLTYQNKVVKVQRPTPTGTVMDIISRKDQRGSGQVGTYGLNTFTNMEAQLVRQMEGEGVLSKTDLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAIPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4556 - protein, 3290 aa, Artificial Sequence
  derived and/or modified protein sequence (wt) from DENV-3__KF954945__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLAILRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSMLASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKDGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTMAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKTDLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAIPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4557 - protein, 3290 aa, Artificial Sequence
  derived and/or modified protein sequence (wt) from DENV-3__JX669495__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4558 - protein, 3290 aa, Artificial Sequence
  derived and/or modified protein sequence (wt) from DENV-3__JX669499__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGITYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4559 - protein, 3290 aa, Artificial Sequence
  derived and/or modified protein sequence (wt) from DENV-3__JX669492__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4560 - protein, 3290 aa, Artificial Sequence
  derived and/or modified protein sequence (wt) from DENV-3__JX669500__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4561 - protein, 3290 aa, Artificial Sequence
  derived and/or modified protein sequence (wt) from DENV-3__JX669497__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNASKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4562 - protein, 3290 aa, Artificial Sequence
  derived and/or modified protein sequence (wt) from DENV-3__JX669501__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLTMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAMEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVMYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4563 - protein, 3290 aa, Artificial Sequence
  derived and/or modified protein sequence (wt) from DENV-3__JX669494__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNTVSRLLLNRFTMTHRRPTTEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4564 - protein, 3290 aa, Artificial Sequence
  derived and/or modified protein sequence (wt) from DENV-3__JX669503__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVVLAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4565 - protein, 3290 aa, Artificial Sequence
  derived and/or modified protein sequence (wt) from DENV-3__JX669493__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYIGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4566 - protein, 3290 aa, Artificial Sequence
  derived and/or modified protein sequence (wt) from DENV-3__JX669504__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTLVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNTVSRLLLNRFTMTHRRPTTEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4567 - protein, 3290 aa, Artificial Sequence
  derived and/or modified protein sequence (wt) from DENV-3__JX669506__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAYNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4568 - protein, 3290 aa, Artificial Sequence
  derived and/or modified protein sequence (wt) from DENV-3__JX669496__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCANTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNTVSRLLLNRFTMTHRRPTTEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4569 - protein, 3290 aa, Artificial Sequence
  derived and/or modified protein sequence (wt) from DENV-3__JX669490__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4570 - protein, 3290 aa, Artificial Sequence
  derived and/or modified protein sequence (wt) from DENV-3__JN406515__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDEQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDVEQMANGIALGLMALKLITQFETYQLWTALVSLMCSNTIFTLTVAWRTATLILAGISLFPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTMMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKAPVTTWEDVPYLGKREDQWCGSLIGLTSRATWAQNILTAIQQVRSLIGNEEFLDYMPSMKRFRKEEESEGAIW

SEQ ID NO: 4571 - protein, 3290 aa, Artificial Sequence
  derived and/or modified protein sequence (wt) from DENV-3__JN406514__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFLDLPLPWTSGATTERPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFSTNIWLKLREVYTQSCDHRLMSAAIKDERAVHADMGYWIESQKNGSWKLEKASFIEVKTCIWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHKQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4572 - protein, 3290 aa, Artificial Sequence
  derived and/or modified protein sequence (wt) from DENV-3__KT726340__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVITKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4573 - protein, 3290 aa, Artificial Sequence
  derived and/or modified protein sequence (wt) from DENV-3__KT726345__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADIIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4574 - protein, 3290 aa, Artificial Sequence
  derived and/or modified protein sequence (wt) from DENV-3__KT726349__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETESILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4575 - protein, 3290 aa, Artificial Sequence
  derived and/or modified protein sequence (wt) from DENV-3__KT726347__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLAMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4576 - protein, 3290 aa, Artificial Sequence
  derived and/or modified protein sequence (wt) from DENV-3__KT726352__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPAIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4577 - protein, 3290 aa, Artificial Sequence
  derived and/or modified protein sequence (wt) from DENV-3__KT726356__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLLAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTYRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4578 - protein, 3290 aa, Artificial Sequence
  derived and/or modified protein sequence (wt) from DENV-3__KT726342__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4579 - protein, 3290 aa, Artificial Sequence
  derived and/or modified protein sequence (wt) from DENV-3__KT726343__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4580 - protein, 3290 aa, Artificial Sequence
  derived and/or modified protein sequence (wt) from DENV-3__KT726351__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4581 - protein, 3290 aa, Artificial Sequence
  derived and/or modified protein sequence (wt) from DENV-3__KT726360__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKDPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4582 - protein, 3290 aa, Artificial Sequence
  derived and/or modified protein sequence (wt) from DENV-3__KF041259__SS-prME
TSLCLMMILPAALAFHLTSRDGEPRMIVGKNERGKSLLFKTASGINMCTLIAMDLGEMCDDTVTYKCPHINEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGRLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFKMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4583 - protein, 3290 aa, Artificial Sequence
  derived and/or modified protein sequence (wt) from DENV-3__KF041258__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLMTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYVLRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4584 - protein, 3290 aa, Artificial Sequence
  derived and/or modified protein sequence (wt) from DENV-3__KF041257__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLREKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4585 - protein, 3290 aa, Artificial Sequence
  derived and/or modified protein sequence (wt) from DENV-3__KF041255__SS-prME
TSLCLMMILPAALAFHLTSRNGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFKMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4586 - protein, 3290 aa, Artificial Sequence
  derived and/or modified protein sequence (wt) from DENV-3__KF041256__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATLTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEKPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFKMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPIHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4587 - protein, 3290 aa, Artificial Sequence
  derived and/or modified protein sequence (wt) from DENV-3__KF041254__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGVVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWRTWGKAKIVTAETQNSSFIIDGPNTPECPSASRAWNVWEVEDYGFGVFTTNIWLKLREMYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKRKLRPRWLDARTYSDPLALKEFKDFAAGRKSIALDLVTEIGRVPSHLAHRTRNALDNLVMLHTSEHGGRAYRHAVEELPETMETLLLLGLMILLTGGATLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLARAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSKLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4588 - protein, 3290 aa, Artificial Sequence
  derived and/or modified protein sequence (wt) from DENV-3__KX380841__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKDGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTMAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKTDLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4589 - protein, 3290 aa, Artificial Sequence
  derived and/or modified protein sequence (wt) from DENV-3__KX380842__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSMLASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKDGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTMAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKTDLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAIPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4590 - protein, 3290 aa, Artificial Sequence
  derived and/or modified protein sequence (wt) from DENV-3__KX380839__SS-prME
TSLCLMMMLPATLAFHLTSRDGEPRMIVGKNERGKSLLFKTASGINMCTLIAMDLGEMCDDTITYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEATLPEEQDQNYVCKHTYVDRGWGNGCGLFGKGSLVTCAKFQCLELTEGKVVQHENLKYTVIITVHTGDQHQVGNETQGVTAEITPQASTVEAIFRSYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWAALVSLMCSNTIFTLTVAWRTATLILAGISLLPMCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTAEAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPPHLAHRTRNALDNLVMLHTSEYGGRAYRHAVEELPETMETLLLLGLMILLTGGVMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLISGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMISRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4591 - protein, 3290 aa, Artificial Sequence
  derived and/or modified protein sequence (wt) from DENV-3__KX380840__SS-prME
TSLCLMMMLPATLAFHLTSRDGEPRMIVGKNERGKSLLFKTASGINMCTLIAMDLGEMCDDTITYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEATLPEEQDQNYVCKHTYVDRGWGNGCGLFGKGSLVTCAKFQCLELTEGKVVQHENLKYTVIITVHTGDQHQVGNETQGVTAEITPQASTVEAIFRSYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPNALRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWAALVSLMCSNTIFTLTVAWRTATLILAGISLLPMCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTAEAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPPHLAHRTRNALDNLVMLHTSEYGGRAYRHAVEELPETMETLLLLGLMILLTGGVMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLISGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMISRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4592 - protein, 3290 aa, Artificial Sequence
  derived and/or modified protein sequence (wt) from DENV-3__JF808121__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFSGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLTMIGSNASDRMGMGVTYLALIATFKIQPFLALGFFLRKLTSRENLLLGVGLAMATTLQLPEDIEQMANGIALGLMALKLITQFETYQLWIALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMKHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWKTLGRNKKPRLCPREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGSGWSLRETACLGKAYAQMWSLMYFHRRDLRLASNAICSAVPVHWVPTSRMTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4593 - protein, 3290 aa, Artificial Sequence
  derived and/or modified protein sequence (wt) from DENV-3__JF808120__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLKQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFNLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGILGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIIDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMTTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGSGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4594 - protein, 3290 aa, Artificial Sequence
  derived and/or modified protein sequence (wt) from DENV-3__JF808119__SS-prME
TSLCLMMILPTALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFMFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIIKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGEDCVLKPIDDRFDNALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHALHQWMTTEDMITVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4595 - protein, 3290 aa, Artificial Sequence
  derived and/or modified protein sequence (wt) from DENV-3__JF808118__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLAILRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4596 - protein, 3290 aa, Artificial Sequence
  derived and/or modified protein sequence (wt) from DENV-3__JF808127__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSLTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAEPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLNKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVKMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPKLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4597 - protein, 3290 aa, Artificial Sequence
  derived and/or modified protein sequence (wt) from DENV-3__JF808124__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTFGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEELVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTCVLLLSGQITWRDMAHTLIMIGSNASDRMGMGVTYLALIATFKIQPFLALGFFLRKLTSRENLLLGVGLAMATTLQLPEDIEQMGNGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLILSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIGARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIIYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMSWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4598 - protein, 3290 aa, Artificial Sequence
  derived and/or modified protein sequence (wt) from DENV-3__JF808126__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFLDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKSKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPALRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSCPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLVSYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVQNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRRWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLPWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4599 - protein, 3290 aa, Artificial Sequence
  derived and/or modified protein sequence (wt) from DENV-3__JF808125__SS-prME
TSLCLMMILPAALAFHLTSRDGEPRMIVGENERGKSLLFKTASGINRRTLIAMDLGEMCEETETYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATAETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISSGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLRLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4600 - protein, 3290 aa, Artificial Sequence
  derived and/or modified protein sequence (wt) from DENV-3__JF808129__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNCTMGVLCLAILFEDVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMTTVDDDGTMRIKDDETENILTVLLKTALTIVSGVFPYSIPATLLVWHTWQKQTQRSGVLWDVPSPPETQKAEQEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPTYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRTKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4601 - protein, 3290 aa, Artificial Sequence
  derived and/or modified protein sequence (wt) from DENV-3__JF808123__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATHLATLRKLCIEGKITNITTDSRCPTQGEAVLPEEQDQNYVCKHTYVDRGWGNGCGLFGKGSLVTCAKFQCLGPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4602 - protein, 3290 aa, Artificial Sequence
  derived and/or modified protein sequence (wt) from DENV-3__JF808128__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQRTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFLDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKSKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPALRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLVSYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRRWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASRSMSWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4603 - protein, 3290 aa, Artificial Sequence
  derived and/or modified protein sequence (wt) from DENV-3__JF808122__SS-prME
TSLCLMMILPAALAFHLTSRDGEPRMIVGKNERGKSLLFKTASGIIKCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEAPHLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSFLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMSWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKANGSRAIWYMWLGARYLEFEALGFLKEYHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDTGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4604 - protein, 3290 aa, Artificial Sequence
  derived and/or modified protein sequence (wt) from DENV-3__GQ466079__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSFFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLENLELDFTYCEGTTVVITENCGTRGPSLRTTTVSGKLIHEWCCRSCTLPPLRYMGEDGCWYGMEIRPISEKEENMVKSLVSAGSGKVDNFTMGILCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMSATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWLVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGSRYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4605 - protein, 3290 aa, Artificial Sequence
  derived and/or modified protein sequence (wt) from DENV-3__FJ898462__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQRGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPIVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4606 - protein, 3290 aa, Artificial Sequence
  derived and/or modified protein sequence (wt) from DENV-3__KF955473__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLAILRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4607 - protein, 3290 aa, Artificial Sequence
  derived and/or modified protein sequence (wt) from DENV-3__FJ850079__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNVEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHDSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4608 - protein, 3290 aa, Artificial Sequence
  derived and/or modified protein sequence (wt) from DENV-3__FJ850080__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFMFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIIKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4609 - protein, 3290 aa, Artificial Sequence
  derived and/or modified protein sequence (wt) from DENV-3__FJ850083__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKREVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGTITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4610 - protein, 3290 aa, Artificial Sequence
  derived and/or modified protein sequence (wt) from DENV-3__FJ850086__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRAGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKTVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFMFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIIKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4611 - protein, 3290 aa, Artificial Sequence
  derived and/or modified protein sequence (wt) from DENV-3__FJ850089__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEVILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKVGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQIIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4612 - protein, 3290 aa, Artificial Sequence
  derived and/or modified protein sequence (wt) from DENV-3__FJ850092__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEVILPEYGTLGLECSPRTGLDFNEMILLTMKNKAWMVHRQWFFDLPLPWTSGVTTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKVGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLIVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4613 - protein, 3290 aa, Artificial Sequence
  derived and/or modified protein sequence (wt) from DENV-3__FJ850094__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTGTPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTFKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNGIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4614 - protein, 3290 aa, Artificial Sequence
  derived and/or modified protein sequence (wt) from DENV-3__FJ898446__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFETTARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4615 - protein, 3290 aa, Artificial Sequence
  derived and/or modified protein sequence (wt) from DENV-3__GU131844__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNVKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAAQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKIAQWLETKGVERLKRMAISGDDCVVKPIDDRFANALLALNDMGKVRKDIPQWQPSKGWHDWQQVPFCSHHFHELIMKDGRKLVVPCRPQDELIGRARISQGSGWSLRETACLGKAYAQMWSLMYFHRRDLRLASNAICSAVPVHWVPTSRTTWSIHAHHQWMTTEDMLAVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4616 - protein, 3290 aa, Artificial Sequence
  derived and/or modified protein sequence (wt) from DENV-3__GU131849__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTIEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATMLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENSHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4617 - protein, 3290 aa, Artificial Sequence
  derived and/or modified protein sequence (wt) from DENV-3__GQ868546__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4618 - protein, 3290 aa, Artificial Sequence
  derived and/or modified protein sequence (wt) from DENV-3__GU131850__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVIKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADIGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPNSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKKGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4619 - protein, 3290 aa, Artificial Sequence
  derived and/or modified protein sequence (wt) from DENV-3__GU131851__SS-prME
TSLCLVMILPAALAFHLTSRDGEPHMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWLFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4620 - protein, 3290 aa, Artificial Sequence
  derived and/or modified protein sequence (wt) from DENV-3__GQ868547__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKMVTAETQNSSFIIDGPNTPECPSASRAWNVWEVEDYGFGVFTTNIWLKLREVHTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4621 - protein, 3290 aa, Artificial Sequence
  derived and/or modified protein sequence (wt) from DENV-3__GU131857__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4622 - protein, 3290 aa, Artificial Sequence
  derived and/or modified protein sequence (wt) from DENV-3__GU131858__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVIKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADIGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTSGPSLTTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPNSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4623 - protein, 3290 aa, Artificial Sequence
  derived and/or modified protein sequence (wt) from DENV-3__GQ868548__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4624 - protein, 3290 aa, Artificial Sequence
  derived and/or modified protein sequence (wt) from DENV-3__GU131861__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTVTKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAVVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKKIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4625 - protein, 3290 aa, Artificial Sequence
  derived and/or modified protein sequence (wt) from DENV-3__GU131862__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVIKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADIGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSITLDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPNSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWKTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4626 - protein, 3290 aa, Artificial Sequence
  derived and/or modified protein sequence (wt) from DENV-3__GU131865__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTVTKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAVVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMTGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4627 - protein, 3290 aa, Artificial Sequence
  derived and/or modified protein sequence (wt) from DENV-3__GU131866__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDRRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHAWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRKLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4628 - protein, 3290 aa, Artificial Sequence
  derived and/or modified protein sequence (wt) from DENV-3__GU131868__SS-prME
TPLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFNNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTKAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEASAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPSVVSPTSYLDVDLHPASAWTLYAVATTVITPMLRHTIENSTANVSLAAIANQAVVLMGLDKGWPISKMDLGVPLLALGCYSQVNPLTLTAAVFLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4629 - protein, 3290 aa, Artificial Sequence
  derived and/or modified protein sequence (wt) from DENV-3__GU131869__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDIAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATRSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4630 - protein, 3290 aa, Artificial Sequence
  derived and/or modified protein sequence (wt) from DENV-3__GU131870__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNHILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLIVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALVALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4631 - protein, 3290 aa, Artificial Sequence
  derived and/or modified protein sequence (wt) from DENV-3__GU131871__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTTGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4632 - protein, 3290 aa, Artificial Sequence
  derived and/or modified protein sequence (wt) from DENV-3__GU131872__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKMVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4633 - protein, 3290 aa, Artificial Sequence
  derived and/or modified protein sequence (wt) from DENV-3__GU131873__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVVITVHTGDQHQVGNETQGITAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNVNTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFIISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4634 - protein, 3290 aa, Artificial Sequence
  derived and/or modified protein sequence (wt) from DENV-3__GU131874__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAAQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKRPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKIAQWLETKGVERLKRMAISGDDCVVKPIDDRFANALLALNDMGKVRKDIPQWQPSKGWHDWQQVPFCSHHFHELIMKDGRKLVVPCRPQDELIGRARISQGSGWSLRETACLGKAYAQMWSLMYFHRRDLRLASNAICSAVPVHWVPTSRTTWSIHAHHQWMTTEDMLAVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4635 - protein, 3290 aa, Artificial Sequence
  derived and/or modified protein sequence (wt) from DENV-3__GU131875__SS-prME
TSLCLVMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKVDRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4636 - protein, 3290 aa, Artificial Sequence
  derived and/or modified protein sequence (wt) from DENV-3__GU131877__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLVILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIISGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFSGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4637 - protein, 3290 aa, Artificial Sequence
  derived and/or modified protein sequence (wt) from DENV-3__GU131878__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLELIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAAIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4638 - protein, 3290 aa, Artificial Sequence
  derived and/or modified protein sequence (wt) from DENV-3__FJ898455__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVHKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4639 - protein, 3290 aa, Artificial Sequence
  derived and/or modified protein sequence (wt) from DENV-3__GQ199891__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4640 - protein, 3290 aa, Artificial Sequence
  derived and/or modified protein sequence (wt) from DENV-3__FJ898443__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKMKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEELEGAIW

SEQ ID NO: 4641 - protein, 3290 aa, Artificial Sequence
  derived and/or modified protein sequence (wt) from DENV-3__FJ898444__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDEQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSREPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKKGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4642 - protein, 3290 aa, Artificial Sequence
  derived and/or modified protein sequence (wt) from DENV-3__FJ898445__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKREEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWMESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGMLETTKRDLGMSKEPGVASPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRSMPGTRRVMGITAEWLWRTLGRNKKPRLCTREEFTRKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4643 - protein, 3290 aa, Artificial Sequence
  derived and/or modified protein sequence (wt) from DENV-3__GQ868571__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGMLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4644 - protein, 3290 aa, Artificial Sequence
  derived and/or modified protein sequence (wt) from DENV-3__GU131951__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMSKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPEAQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVTPEGRVIDLGCGRGGWSYYCAGLKKVTEVRGYTKGGPGHEEPVPMSTYGWNIVKLMSGKDVFYLPPEKCDTLLCDIGESSPSPIVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4645 - protein, 3290 aa, Artificial Sequence
  derived and/or modified protein sequence (wt) from DENV-3__GQ868572__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKVHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4646 - protein, 3290 aa, Artificial Sequence
  derived and/or modified protein sequence (wt) from DENV-3__GQ868573__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGLPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4647 - protein, 3290 aa, Artificial Sequence
  derived and/or modified protein sequence (wt) from DENV-3__GQ868574__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFSYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGMLETTKRDLGMSKEPGVASPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4648 - protein, 3290 aa, Artificial Sequence
  derived and/or modified protein sequence (wt) from DENV-3__GQ868575__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNFSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFGLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSREPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPEIPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4649 - protein, 3290 aa, Artificial Sequence
  derived and/or modified protein sequence (wt) from DENV-3__GU131953__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNAVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLIRQMEGEGVLSKADLENPHLSEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4650 - protein, 3290 aa, Artificial Sequence
  derived and/or modified protein sequence (wt) from DENV-3__GQ868577__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKIAQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMENKTPVTTWENVPYLGKREDQWCGSLIGLTSRATWAQNIPTAIQQVRSLIGNEEFLDYMPSMKRFRKEEESEGAIW

SEQ ID NO: 4651 - protein, 3290 aa, Artificial Sequence
  derived and/or modified protein sequence (wt) from DENV-3__GU131954__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGVMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMTKEPGAVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4652 - protein, 3290 aa, Artificial Sequence
  derived and/or modified protein sequence (wt) from DENV-3__GQ868578__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCKWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPTSEKEENMVKSLVSAGSGEVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKIAQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLMGNEEFLDYMPSMKRFRKEEESEGAIW

SEQ ID NO: 4653 - protein, 3290 aa, Artificial Sequence
  derived and/or modified protein sequence (wt) from DENV-3__FJ898457__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKTVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4654 - protein, 3290 aa, Artificial Sequence
  derived and/or modified protein sequence (wt) from DENV-3__KF955505__SS-prME
TSLCLMMILPAALAFHLTSRNGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCPREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLPKLGYILRDISKIPGGAMYADDTAGWDTRITEDDLHNEEKIPHQMDPEHSRLANAIFKLTYQNKVVKVQRPTPTGTVMDIISRKAQRGSGQVGTYGLNTFTNMEAQLIRQMEGEGVLSKADLENPHLPEKKITQWLETKGVERLKRMAITGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4655 - protein, 3290 aa, Artificial Sequence
  derived and/or modified protein sequence (wt) from DENV-3__FJ898464__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4656 - protein, 3290 aa, Artificial Sequence
  derived and/or modified protein sequence (wt) from DENV-3__JQ922556__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEAPARGARRMAILGDTAWVFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPSTPECPSASRAWNVWEVEDYGFGVFTTNIWLKLREVYTQMCDHRLMSPAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMAFKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVGTGTSADLTVEQAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSPQWQKGEEVQVITVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAINRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFETEYQKTKLNDWDFVGTTDISEMGANFKADRVIDPRRCLKPGILTDGPEGVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKIKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGVSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGELTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSGSSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGGREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVTTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4657 - protein, 3290 aa, Artificial Sequence
  derived and/or modified protein sequence (wt) from DENV-3__JQ922557__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVERLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGKSKRDNSTMGVLCLAILFEEVMRGKFGKKHMIAGVFFTFVLLLSGQITWRDMAHTLIMIGSNASDRMGMGVTYLALIATFKIQPFLALGFFLRKLTSRENLMLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLLITVDDNGTMRIKDDETEIILTVLLKTALQIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGDYLSGIAQTNAEPYGPSPDLEEEMFKKRKLTIMDLHPGSGQTLKYLPAIVRDAIKRRLRILILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDAERDIPERSWNSGNEWITDFAGKTVWFVPSIKAGNDIANCLRKNGKKVIQLSRKTFETEYQKTKLNDWDFVVTTDISEMGANFKADRVIDPRRCLKPVILTDGPKRVILAGPMPDTAASAAQRRGRVGRNPQKENDQYIFPGQPLNTDEDHAHWPETKLLMDLFTTPEGILPSHFDPHGENFPEISGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDSHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPMTTLWEGSPGKIWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMHWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENPPYLGKREDQWCGSIIGLSSRATWAQNIPTAIQQVRSLIGNEEFLDYMPSMKRFRKEEESEGAIW

SEQ ID NO: 4658 - protein, 3290 aa, Artificial Sequence
  derived and/or modified protein sequence (wt) from DENV-3__JQ922555__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTAEAILPEYGTLGLECSPRTGLDFNEMILLTMKNKAWMGHRQMLFDLPTPWTSGTTTETSAWNRKEPFVTFKNAHTKKQEVVVLGSQEGAMHTALTGATEIQNSGGTSIFAGHLKCRLKMDKLELKGMSYAMCTNTFVLKKEVSETQHGTILVKVEYKGEDAPCKIPFSTEDGQGKAHNGRLITANPVVTKKEEPVNIEAEPPFGESNIVIGIGDKALKINWYRKGSSIGKMFEATSRGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQICDHRLMSAAVKDERAVHADMGYWIESQKNGSWKLEKASLIEVKTSTWPKSHTLWSNGVQESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLASAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMTVAAMGVPPLPLFIFSLKDTLKRRSWPLNEGVMAVGLVSILASSLLRNGVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTSGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTDAKMLLENINTPEGIIPALFEPEREKSAGLDGEYRLKGESRKTFVELMRRGDLPVWLAHKVASEGILYTDRKWCFDGQRNNQILEENMDVEIWTKEGEKKKLRPRWLDARTYSDPLALKEFKDFAAGRKSIALDLVTEIGRVSSHLAHRTRNALDNKMMLHTSEYGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIIAANEMGLLETTKRDLGVSKEPGVVSPTSYLDVDLHPASAWTLYAVATTVIAPMLRHTIENSTANVSMAAIANQAVVLMGLDKGWPISKMDLGVPLLALGCYFYVNPLTLTAAVFLLVTHYAIIGPGLQAKATREAHKKTAAGIMNPPPGDGIMTIDLDPVIYDSKFEKQLGQVMLLVLCAVQLLLMRTSWALCEALTLATGPTTTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGKGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSRNEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRLMPRTRKVMEITAEWLWRTLGRNKRPRLCTREEFTKKVRPIAAMGAVFTQRDQWDSAKAAVEDEEFWKPVDRECNSHQLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRNTEDDLHMKEKITQQMGPGHSRLANAIFKLTYQNKVVKVQRPTPTGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4659 - protein, 3290 aa, Artificial Sequence
  derived and/or modified protein sequence (wt) from DENV-3__GU131903__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHSGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKAGPGHEEPVPMSTYGWNIVKLMSGKDVFYLPPEKCDTLLCDIGESSPSPTVEESRTIRVLKMVEPWLRNNQFCIKVLNPYMATGIEHLERLQRKYGGMLVRNPLSRNSTHEMDWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4660 - protein, 3290 aa, Artificial Sequence
  derived and/or modified protein sequence (wt) from DENV-3__GU131904__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENSIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLRKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMAGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4661 - protein, 3290 aa, Artificial Sequence
  derived and/or modified protein sequence (wt) from DENV-3__GU131906__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPRRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLGKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4662 - protein, 3290 aa, Artificial Sequence
  derived and/or modified protein sequence (wt) from DENV-3__GU131907__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALTATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4663 - protein, 3290 aa, Artificial Sequence
  derived and/or modified protein sequence (wt) from DENV-3__GQ868634__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW
